United States Patent 8,298,762 (SPECIFIC DNAS FOR EPIGENETIC CHARACTERISATION OF CELLS AND TISSUES) - sequence listing, part 2

SEQ ID NO: 69 - DNA, 242981 bp, Homo sapiens
gttttagaaatgatagtgaaaagttaattttttatattttatttataatgtaaaatattagtttaaatttgtagaaagtatattttttgaataaaagatagtagatgttgtagtatttttgttaaagaaagagtttagtataaatattttgtagtatgtaaatgttattttttttatgtgaatattttttttgagtggatgttgtagggttggaggtttttgtttatgatttaggttgtaattttatttgtggaaataaattaattgtggagttttaattgttttggtggtgaggtgattaatagtttattattggatagaatagtgattataggaagagtattgaagattttaatgtatgaattatgtatgtagtgtttattttttagtttttgaatagaatgatagggtttgtgaagttgttttagatagttttttgtattaagtgattgtagtgaaatgtttaatatttttaggtatagaagtagtattgatttgggttagttgaatttggaagatgtaaattttttagtttatagtatggaatgttttatttgaaagtattgttatgtagatagttggtttttttgttatttaatttgttttttttaggttggttgaaggatgggagtggttgtgtttgtttgtgaggttatagtatgaagtttttttaatttgttttttgttgtaggagagaggtgtattgtggtataattgttgttgtatttatttaaatggataatttgtaatagatattatatttaggatgatagataagttaatatataaggtaagtttaaggttttttttataggttaggtaattgtaaattagaatatgttgagttaggataatggtgatgtgatattaataaggttgatttagattttagtattgtaatgttagtattaggatttttaattgttatgttaaatgagaggtgattttttatatttgatagtattggattatagggtattttattttgtatgtaaaagttttttaagaatgtattagagtttgaatgtgtagaagattgtaaattggggaggggtagtagtagaatgagttgaattaataagtggaaattatttttttgtggggaagttttagtatggttgtggtattgtgttggtttagattatttttttaatgttaatatttttaaattttagtaaaagatgtgggtagatattagaaatgtttaattttttttttagaagtagaggaaagtattgaggtatttaaatttaaatattgtgttgtatataaattgagtagatggaattaaaataatttggattagtatgtttttgagggaagattttgttgttaaataaattatttgatttttatttgtgttggtttggttttgttttttttttttgttaagaatgttttattttaaaatgtatggatagatgatgtgttgtgatatttatttaaaaaagagttttattttttgtttttttaaaaattatttttatataattataggatttattatataagatttaaataaaatttataaaaattttgtaaaattgaaaaatatagtattatatgagtatatttgttagaagttattgttaattaaagttttttgtttaaatattatggtaaatgattaatttttgaatatttttttaggatgagaaaatagaattaataaatataaagtaagagatattagataagtaaaattttttaaggttattttttaatttatattattagtgaatatatattattagtgaatatatatattagtgaatttatattattagtgaatatatatgtatatatatatatatatattataatttatagtttataaaatataatatatgtattataatatataggtatatttatttttttatgtatgtttattaatattgtttttaaaagtgtgtttgttaaattatttattaagattaagaatagataaggataagtatgttttgggaaaaaaaagtattattttattttttttaaaaagaaagaaatttagagtaatgatgataataagagtatagtataaaatgttatattttatgtattttaattttgttataatgttgttatattatttggattttttgttgtttaggtgttgtgtatagaatttttagtattatagaatggtttaaatttttaaagttgatttagtttaggtataagaggaaatttatatttgaagtttttttttagggaggggaaaaaaggaaggagatattattatttatatattttagaagttttttgatgttgagttatggtgtttagttttgttgaaatgttttttggttgaggtggttgattaatagttaataaaatggaatttagaggaaaatgagaaagaatggaggggggtagaaatttaaagatatttattgtttaatgatatatattaaattttgagtaataagtagaatggtagtgttatttgttggatttggttgagttgatagtaggagaataaaagtttttgtgttgggtgataagattatagtagtagaattaatggtttaataaggggagagtgtataaataaagggatttaagaagtattgtttttgtatttatttaaatttttttgttttttttttagttttaatttaagttattagttaattttatttaaaagatataatgtttagataaagaatagtttttagattatgtaaggaaaatttagaataagatgtgtttagtttttgttttttatggtggttataattaatttttataggttattaattgggaggaattaataaaaaattgatgagaatttttaaatattttgtttggtatatatgaggtattaaaatgagtttagatagtgattattatggtaatatataattgtattagatataattggaaatggagattgaatatattataaaaatatatattaaaaaggaaatagggtaaatggaatgagagagtagtgaaatattaaatataagattttgaaagaaaaatgtatttaaattgtagttgatatatattattagtgatttaaaattaatgtataaaaaattttgaagtaataggtttattaatataagggtttataatttttttaaaaataaattttaagggtgatttagagtgagaaataattgataataatattttaaagtagaaaggtgtaatatttttttatagggaataaatattgatagagttaaaatatatttgtatttatgttgtaataaattgaagtagaaatttttttatatatattgagagagagggagaaagtatagtgtatatatatatatatatatatatatatatatatatatatatatattttttatttgtttatttaattatttagttttttatttagtaattattataagtgatttgtaattattataattttaagtggtagttatatatatatatatatatatatatatatatatatatatatatatatatatatatatattatatatgaaatatatatattataagttaatatatagtatagtatatatatttatagtatatatattataaatatatataatatagtatatatattatatatatattatatatattatatatatatagtatattatatatattgtaaatatttatagtatatatattataaatatatattgtaaatgtatagtatatatatttatttatagtatatatatttatatatataattaaatgtatatattatatttatttaggattgtggtagttatagattatttatggatgattaggaggtttataagtatttgaaaagaggtaatatatttatttttaataaagtaagttaatatgaaaattgaggaaattagagtttatgtttagataataagaaaattttttatagggtattttagtaaatagttttgatgagttgtaagttttgtgaaatttatagaaaatttttgtaagtatgaatttataataaagagtgattgttgggagatattattttttttttttttttatttgagaaaaatgattaaattggtttttttttaaaatgttttttttgagtaattaatatatgaaatattttttttttagatatgtttttaagggttgattttgaggagtgttttagtttaatatagttttatggatgttttattaatttatttttttttattgtaaatatattttttattttatttttattgtttattaatttttttttttttataagataatttagtgtaataaggaagtatttattgagaatttttttgtttggttttgttaggtattttggttttgtagatgtaaaagatgaagggtttgtgtttttaatgggaataaataagttaaatgtagggggaaaaagataaaatataggagtatttaaaaatatttggtaaaatgttttattgttataggagaaatgaggaattatgtataatattttttaaatggtatttggaggaagaatatgtataaaagtatggaggttaaaattaatagtatatattttaatgttggtattgaaatagagggattggatgggtggtgtagttgagaataaataaggtggggtaggttattaggaatttagttattagaataatatgtttagatttgatttaataggtagtgaatatttatagatattgtttaattttattggaggtatttaatgataaagaagtatttgatttttgaattagataaatttttagtatttttttttaatggttgttaattttaaattaaatagttatgtattatataaatattttttgattgtatatttgatagtggttttatgagattataatggagtagaaaattttttgttgtgtagtgatatggtagtttttgtaatgatatagagtaatatattattttttttttatgtttagatatataaatatttattattgtgttatatttgtttatagtatttagtatggtaatatgttgtttatgtttgtagttgaggaataataggttatgttatatagtttatgtatgaagtaggttagattatttaggtttgtgttaagtatattttgtgatgtttttatagttaaaattatttaattgtttattttttagaatgtatttttatagttaagtgatgtataattgtattgtattaattatgttttttattttttgaattttgatattttagttttgtagattttggaaggattattttttttaggtgttagttgattattggagttagtatataatttgtttttgagtatattttttaaatgtaaattaattaatttagagttttattattataattattttttttatttgggtttttatattttgggttattatttatttggttaattattttggggatatatattagataagtgataaatgaaattttttaaattagttaattttaagtatttatttgtttttgtttgttttggtgaaaattatatagttttttttttttttttttgttttttgattagttttagtttttttttatgttgttttttgtggtgtgttgtgttttttgttttggtgatttgtgggtttaataagttattttttttttttgagatggagttttattttgttgtttaggttggagtttagtggtgtagttttggtttatggtaattttttggagtgtaatggtgtaattttggtttattgtaatttttattttttaagtttaagtgatttttttgttttggttttttgagtagttgggattataggtatgtgtttttatatttggttaatttttgtattttttagtagagatagggttttattatgttggttaggttggttttgaatttttggttttagatgatttgtttattttagttttttaaagtgttgagattataggtgtgaggtattgtatttggttaataagttgtttttttaatgatagttgtttttagatttgttgtttttaataaatttaaataataaaatttatattaaaataaatatttaaaaattttttaaattttaatataaattaatataaatagaaatattatatttttaggatatgaaataaattagttaagtttttttttttaaaaaaaaaaattattatttttttattaaattgttattttattttgaatttaaggattaattttgaatgaattttttataaaaataagtttaattattttttaagttgtggttgataaagggagggtatattttttagaaatgtgaatgggtaattagaagtttttagttttatgttaagatatataagtttaaagttttaaatatttttttgagattgttttaatttgtagtatgttatatttattgtatggaaataagtatttattttgttaaataattaaattaatgttgagggaaaatgttatttttatatttgaatatagaaattttgaaattgtaattattaaatgttagttttgtttatataatgtttttaatatttgatgaggaattatattatatattttaataaaaataaattttgttatattaagttataaaattgaattgaattgtatttttttgagaatagtgtttaaggagagattgttaattagtgaatgtaaaattttagaataatgaattaaatgtaattaagtagaagattaataagaattatattatatagaaaattgtgttttgaagaatatgtattataagattgtattttttggtggtgtattttattattttaaaatattattattgaaagaagagaatagtaaatgattttaagaggtagaataatttaaatattaaatgtatgtttgatttttatggttattaattgtttttttatttgttttgtttttagattgtattataagttattattgtaattgtaatagttttttgagaaataaatttttgaaaaatttaagtggtaaattgatggtttaggttgggaataggttagaaaagatattagttatgatagtagatggaagggtagtaaggtaggtggttgggagggaatttggaggtggagttgtgttagaaagaatataggaatttaaatagatggaagatgatatattagttggtagggagagttgttgggtgataagtagatgaatttattgaagaattgggtggataggtagttaataagtgaattagatgaattagtaataaaagaaatagattagtatgagggtatttaagttttagaataaattgataagaataatagaaaataattataattgtttttttgtttgaatttgaggaaatgatttttattgtaattttttaaagtgtttagaagtgatgatgaataaatgatgataaataagatgatgattattttttatagaaggaaaattttagtataaaatttaaagatgtttattattaaataaatatattttataaaattattatgagtatataatttattttatgttttagttttgggttttttataaattgagttttggttttggtttggttaatgtatgaggttatggggatttggttggaaaataatattgatgtatagtaaaagtggagaataagaattttaattttttttaaaaaagagaatttattagattatggtaaatgtgaatatgatattatttttataaaaatagtttatgttgtttttgtttattaaaaatgataatagtagtgttttaatgaggataaagaagattattataagttatttggttttttttttgtttttagatttatttatttttaaattattatatttttaggtaattatttatatttgtaagtatttagtataattgtgtagtgtagttttgtattttttaaatgatagttgttattatgggttgatagaaagtattatatttaggaatatttgtaggaaggatttggtttaataggattattttgattgatttttagataattatatggttttttagtagagaagatattttaatttgttatattataagtttaaaatttatattttttttatttttttatttaatttataaatttatttttttggtattgttaattatgttttttaggttagtttattattttttattttattagttaaagtttatatgttattatgtttgaaattgtgttgttttattgttaatatgattatttttaaaatatttgtatttttattaattttatatatagaattagggattatttattttaagggttgtttgagttatatgaatattttttttaagtgaattttttttagttgatattttaattttttgaattaaatttttgagtttaggttagtagtagtgttttttgaaattttaaatgttatttatatatatatatatatatatatatatatatatatatatatataagttggagtaattttttaaagaattagatgaggtaaattttatatatatgttaggtattaggttagatattgagggatataaggataaataagatatgaatttttttattagagtttatattttggtggatgaataggtatatatatgtgtgtgtgtgtgtgtgtgtgtatatatgtatgtatatatatatatatatgtatgtatatatatgtatatgtatataggtgtatatatatgtatatatataggtatatatatatgtatatatataggtatatatatatgtatatatataggtatatatatatatatgataatatataattgtatatatgtgtatatatagtatatatgtataaataatatatatgtatatattgtatatatgaatatataattatatatgtatatattataatatatataatatgtatgtatatataatatatatatgtgtatatatatataaaattagatattatggtatattttaatagatgtaatgatattatatttatgtaatatatgtgtatattattttttataattgtaaattttttgaggttagggaatatattaatttattaattagtaaatatttattaagttttttttatgtataatggttatgtaaagggaagatttttttttgttgttatgggtaaaatagtttattgaaaaagggaaaagaaaggagtaaattttttgtgaaatatgatggtatatagtatgtataataagtgtatataaattgggttttaattaaaattaggagaggatattaaggataatttttttaatgaagaaattaaaggatatataggatagtttttaaattatttaagtatttgtataatggttaatttattgttgttataaaataatggtgttgattgtaaattttagatgtttagattaaaaaagatatatgtatttaatgaatataatttgaaaggaagttaattatgtgtttggtgttgagataattatttaagtattagtttatttaattttttttagaatattatgatatttttatttttaagttggatgttatgttattattaaaattttttagtttaggattaggagattaaagttttttttttatattattataattttgttaaatttttttggtattttgtagaaattttaaatgttaatgtatttatatatttagtgatattttggaatttttatatttattagattgtttatttttttttttttttaattaaaatatatataatggggttagtataatgttgtatgttaatttttatttagatgttattgattaggagattggagtggggttttaagatggttgattagaaagaagttttttatgtttattttttttattttaaaaattaaaatagtgtatagatagttatatattgaatatattatttgagagatggtggtggaatttaataaggaagtgataaaaatattaaaagtaggaaggagaagggagagagagatagtttgtttgtttagaattagttggaagttgggagtgattttttagtttagggattaggtgagtaagatatatttaatggtttatattattattatggaattatgtagttttgattataggagaattttttattatttttaatttttgaaattattatagggagttgttaatagattgtagaaagaaggaattgttttagggagggagtttgtattgggttttatattttttttgagatttaagtggttatagtaaggtgttatttttaaatttagtttttgataggttttttgttgttttggggtgtagtagtgttgagtttgaggtgttagggaaatttgggttgtttttgatgggattgaggagtaagttgagaatgtttttatagttaaggttaagaagtaagtgaggtgtgggttgtagtggttattgttaggaagtaagtattgttaggatagagattgagatataagtaggatgtaagttgatattgagatatggatgttagttgggtggatatttttgtagttagggttagggtttgagttaggtttaggttattattggtagtggtggagtatgagatagatttgtgttttttattagttatggttattgaggataattttattttttttaatggtagggttttagtattgttgttattgtttttttttggagtattgtatttggtatttgaggattattttattttatttataatggttggtgtttgttttttttatttggggtattgagtaaaaggttatttagtttggtattgtatttgtaagatagagtatgtagtttgtggttttggggatggtttaatttaatttattattttggaattagagtatttttattagtattttgaagttggttttaaatttttagttattattattttagttggtatttatttgtaagtgttatttgtgagtttggaaatgggtttgtttagtttattgttgttattattaatattaatatatattaattgagatttaaataatttttttgttattgttattgttattttttatgttatattagttatttaatgtttaagtatttgaatatttatttggtttattgttgttattattggaatttgagtaagatatttggagttttaagagttagttttttagtaattgtaaataaaagtatttgtgtatattatttagtggaataaaaataggtaaatttaatttattgttgttagtattgtggtttgaatattggtttatttgatattttagtatttagtataattttattatagtttttattaataattatattttaatttattaaaaaatgataggtattattaatgttgtatgtagtaaaagaaattatatagagatatatttagaattaaagttaaagtattttatttgaataattttatagaaatatttttaggaaaagtttttttttatataagtaaatttaaaaataggaagaagtaatagttatattatatgtgtagatattaatgtaaggatatatgaagtatgaaaaaataaggaaatgtgatattgttagaggaatattgtaattttttagtaatagattttaattgaaataaaatgtaatattttaggtaaagaatttaaaatatttattttttaaatatttagtgaaatataagagaagtttgaaaatgatataaagaaattagaaaaaataatttaggatatgaatgagaaatttattaaagatatttttttttttaagaaaaaataaatagaaattttggaattgaggtattttttgaaggaaaaataaaatatatttgaaagtattaaaattggaagttagattaggtagaagaaataattttagaatttgaagataggttttttgaaataatgtagttagataaaaatatagaaaaaaaatttaaaaagaatgagtaaagttattttgatatttgagataatataaaattattggatagttaagttattgatatttttaagggtgaagaaataataataaaaagattagaaattgtttaatgaaatgatagatgaaaattttttaaatttagtaaaagatttagatatttagataaaagaggtttagtaatttttaggttgataaaatataaatgtgtttttatggtatattatagtatgattgtttaaagttatagataaaaagttaattttaaaaatagtaagagaaaatatttagttatttataaagggaattttattagattaaaagtagatttgttagttgaatatttataggttagaagagaattggatgatttatttagtgttgaaaaaatgttagttaaaaatgttatatttagtaaaattattttttattaatgatgtagaaataaagttttttttagttaagtaaatgttgagggaatttataattattagattagttttataagaaatgtttgttttaaattagaaagtaaaagaataatatttattagtatgaaaataagtaaaagtgtaaaattattggttaaaataataatataaaggaggaagagataaaatttaaatagtgttattgtagaaatttattaaataataaagagtattaataagagaaaaagaaaaggataaggaatatatataataattagaaaataataatatgataggaataaagttttatgtattaataataattttaaatataaatgaattaaattttttatttaaaagttatagattggttgaatagattagaaaatatgaattaatttttgttattaataagaaatttattttattagtgaagatatatatagattgaaagtaaaggaatggaaaaagatattttatataaaaggaaattaaaagtaagtaggaatagttatatttatattaggtaaaatggattttaagtgaaaagtagtttaaaaaaagataaaagttattatataattataaaggaatgaatttagtaagagaatataataattttatatatatatgtatttaatattggagtatttagatttataaagaaaatattattagatttaaagagagagaggttataaagaataatagtgagagattttaatattttatttttagtattaggtagattatttagatagaaaattagtaaagaaatattggatttaaattagtttttagtttaaatggatataatagatatttatataatattttatttagtgatggtagaatatatatttttattataagtatgtggaaaattttttaggatagattatatgtgagatagtaaaataagttttattaattttttttaaaaattgaaattatattaagtatttttttagattataatggaataaaattagaaattaatattaagaggaatattgaaaagtaaataataagtttttgtattaatattgagttaatgaagaaattaagatgaaaataaaaaggttttgaaataaatgaaaataaagatagagtatattaaaatttatagggtatagtaaaagtaatgtaaagagagaattttatagtaataaatgttaatattaaaaaagtagaaaaatttataatttaaaggaattagaaaaataagaataaattaaatttaaaattagtagatgaaaaaaaataaaaatgagattagaattaaatgaaatagagattaaataaataatataaaggattagtaaaataaaaagttggttatttaaaaatataaataaaatggataaatttgtagttaaattaattaagtagaaagatttaaataaataaattaagaaataaaaaaggatatattataatagatattatagaaatatagaagattattagagaattattatgattaattatatattgaaaaattggaaatggataaatttttagaaatatataatttattaaggttaaattaggaggtagaaaatttaaatagattaataataagtagtaagagtgaattagtaataaaaagttttttaatatagaaaaattttgtattagatggaattatagttgaatttaattatatatataaagaagaattaataattatttttttgaaattattttaataaattgaagatgagagtattttttttattttattttatgaggttagtattaatttgatattaaaattagataagaatataataaaataagaaatttttaatatgtttaaggaatatggatataaaaatttgtaataaaatattagtaaaataaatttaataatataataaaaagataatatattttgattaagtggtatttatattaggtatgtaaggattgtttaatatatgtaattttataaaggtgatatattatattaatggaattggggataaaaattatatgatattttaatagatgtagaaaaaaaatttgataaaatttaatatttttttatgataataatttttaataaattaggtatagaaggaatgtattttaatataataaaggttgtataggataaatgtatagttaattttatatttaaaggggaaatgtagaaagttttttttttaagaattagaagaagataaggatgttagttgttattatttttattttatataggattgatatttaaatgttttgatttgattattgtgtattataaatatgtaataaaagtatttattgttttataaatttatataaattttttttaaaaaaagaaataaataaaaagatatttttaattaggagaaagttaaatataatttgaaaaataagttatttataaattttaatttaagttaagttaaaaaggttattttgtttgagtatggaaaatgtgattggtaaatatagaataaagtgttatttgaggaaatatgtatattttataagatgtttgttgtatgtattttgttgaaatattagtgagtattttgatgaataagtttttaataaatttatattaattagtttgttattggtttttttaaaatatgtattgttaatagtaggtagaaggaataagtttagtgtttaataataaaataggaaattgtagttaataataatttatggtatattttaaaatagttagaagagaagaattgttatgtttttaatatgaaagaaaatataaatgtttgaggtgatgggtattttaattattttgatttgattattatatattgtatataggtattaaattattatatgtatttttataatatatataatttatgtattaataattattgtaaaagaaaaaataataatttttagtttttttgaggagatgttttagatatttttgttttttttttatttttgttaagtaaaattaaatattaagtagtagagttttttgtgtaagattgaagattatggagggtaataatttgttttgtttatttttgtatttttagtgtttagtatagtgttttgaatatagtagatgtttaataaatgtatgttgaataaaagagtatatgaattattaatatgaatatattattatttgttatattatttaattaatagatttttagggatttgttatgtttaatgtatatatttaatgtaagatgaattttgtagtagttgattttgttttttaatgatgaaaatgtgttttaaattaatgtaggtaaaagggggattttatgtaatgatataatattatatatttgaaggttgtataagtaaatgttatgaaggatggagttaaggtgtagttggatttaaagtatattttaattagagatatttagaattaatattgttagtttttttgaatatgggttttatttttaatgaaaattaatttttttatgttttagaaaatatatttgattttaagtttaggtatttttatattttgtagtatttttaattttttttttattagtaagtatgtttttgtgatagtttttataaatattatgttgtaaatggttagtttaggtgataaagtataaatattttgttgatatattgattggaaaattaatgggaaaatattaggttgaaaatttgaatagatattttgtttaataaaagttttttgaatattttaataaaaaagaaattgtggtttatgttgaagttaatgaatattagggataaaagtaattaaaatattttaaattattttaagtaatatttgttatttttttagattttatggaaataatattttgtttatttttttatatttttaatatttggtatattgtttggtgtattgtaaattgttggtttatatttgttattaatatattgataataaggtttttttggtttatatatgaatggattataattaggtagttgtgataagaaagtatgtataaaattagtaaatgtattttatattgtgatttatttatatttaaagggtaaattatataatataaattgtttagagataaatgttttgtaagataagtaaggatttagattaaaaagaatatgtttggttgggtttggtttgtattatatttttaaaaatagtttgaaatagtatattgtttttttggaatttattgaagatgttaaatatgtgggaaatttttgagaggagtagaattaagtagaaataataataaagattttgagagaagtggttatttttgttaaattagttagaagaataagaatatggttaaatatttttatatagatatatttggatgagatttttgtaggagtgtgtgaatgttaatattgttaattttgtaataaatgttatattttattgaaaaaattttttggtataatgattttttttttttttttgagatggagttttattgtgttgtttaggttggagtgtagtggtatgattttagtttattgtaatttttgtttttagggtttaagtgatttttttgttttaggtttttgagtagttgggtttataggtatgtgttattatgtttagttaatttttgtatttttagtagagatggggttttattgtattggttaagttggttttggatttttgattttatgatatatttgttttggttttttaaagtgttgggattataggtatgagttattatgtttggttataatgattttttgaagttattgaatgtaagtaaaattataaatattgtttttttgtgtgtgttttttattgaaagtagaatgtagtttttatttatgaaaatatgaatgtttttaagtaaagtttttttttaatttaaattgaatttaaaaaaatgttttttgtagtagtgaaaaaaatatttttggtaatttaagagtgatattatttagaatttttttttttaattttttattaagaataaaatgaaattttagaaatggaagaagttttataaagattgtgattaattttttagtttttataggtagaaattgaattttttatgattgatttttgttgtttaaggatttattatttatgtatatttatgtaatgaaaattaagtttaaaagtataaatagttaaaagtgtaataataattgaaaattgtagtaatgttttttttaattgtataattattgatttaagtttaatgttttttatgtgaattatatttttagtttgagggaaaatattttttaatgaattgtttttgttttgttaagtgatttattttaagaaatagtttttttttagaaaataaaggaaattttaatgaaagaaaaagtatttttttgttattttaaatatgtatattttttagattttaattatggaagagtaatgttgaaagaaaattatttatgagtattgattaggaaattggtgtttattgagatatgtttagtattaatataaatgtaatttttttttaaaagagttagttgtatgttagttgatttgttgaaaatgttttggttatattattaaaaatagaaattttagtggtttttaatttaggaataaataagagtaaaggtgagaaatttgaaatgtaagtttattaatttttttttgttatatagaaaattgattagaattgttagtttagtaaagtgtagatatataatagatattaaatgtagaaaaattaagaatataatattggttataaattagataatgtaagaagaatgaatataggttaatttaatttgttagttttaaatatatattattatttgttttatagtaaaattatattatttattgtgttttattgatagaatagagtattaagtaaaagaagaattattagattattaaaaaataaaaaatgttattatatttgaatttatgttaatgagatggtgttgaataaagtttttagatagttttaagatggggttagttattagaaagattaaataattagagagttggaaattttatttttatttgttagtttttggagatgagaggagggttggagagtgagttatataaattttttattaatgagatttagggagtattttatttggtgagtatattggggtatggggagtgtggtgtatttagagagggtatagaagttttgtattattttttaatttttataatttgttttatgtattttttttatttgtttttgaattgtagtttttataataaattagtaaatgtaaagaaagtgttaaaaataataaaaaatgaatattagtggaatggaaattaaatattttttattaatagtaaaaaatgattattgatagattgagttggggaatgtgaattatatagtgatttttgagtgtgatttaaaatgaatttagtaaatagatttatgggaaataattagtttataggtgataaaaaattattttagtaataatattgtggaggaagttagaaaaatagtaaatttatatagataattgatataaaaaggatagagtaaattttttagtaattaataaataaatggtagggattggggtgagggtaaaaaaaaaatggtttatgtttgtaattttagtattttggaaggttgaggtgggtggattatgaggttaggagattattttgtttaatatggtgaaattttgtttttattaaaaatataaaaaattagtagggtatggtggtgggtgtttgtagttttagttatttgggaggttgaggtaggagaatggtgtgaattttgggggtggagtttgtagtgagttgagattgtgttattgtattttagtttggataatagtgaaattttgttttagaaaagaataagaatttaaatgtttttatgaagttttggtagtatttttattgtttttatgtgttgttattttatatagtagtagaaaagttttattagagttaagtttttattataataatgtttttgtttatttattttattaaattaaggagattttgggagagttttaattagaaatgtataggtatttttattatagtttttttttttttaatttaaatttttgttgttgttgttgttgaggtagagtttttttttgttatttaggttggagtgtagtggtatatttttagtttattaaaatttttattttttgggtttaattgatttttttgttttaggtttttgagtagttgagagtatagaaatatgttattatgtttagttatttttttttattatttttatttttttttgagatggagttttattttgttgtttaggttggagtgtagtggtgtgattttggtttattgtattttttgttttttaggtttaaatgatttttttgtttttattttttgagtagttggggttatgggtgtgtgttattatgtttggttaaattttgtatttttagtagagatggggtttttttatattggttaggttggttttgaatttttgattttgtgatttatttattttggttttttaaagtgttgggatgataggtgtgagtgattgtgtttggttttttttatagttttgatttggttatttttgttttttttttgttttttaattttaagtaatttttaaagggtatttatttttttttaattaataatgtaaaaaagattgtatttatttggttaatttttagggatttttagttttttagggatggattaaatggttggttttatggtttattaaagtattttaaatttgatgaataaagtttatattttttatttttattttttaattatatttttttataaattttttgaagtttttttgtattttaattgtaatttttgtagtaaagtattttaaattagttaaaattttttttttgttttaatgtttatattttaggggaaaaaaattgaatttattaatggttgtttttaatttgtgttatttttaaatgttgtgtttattatttatgtaaattaaaattgtaaattgaaattttaattttattagttttatggaaaagtttagaaagtagtggatttataatgtgaatagtaattataattatattttattagttatattttaggtatatttttgaataagaagttgaattatagtttgaaggagtgggttgttttttttttgttggggattttttattgggaattagtggtttttaattgttttggtattagggataggttttatgtaaaatagtttttttatggatggggtgaggatggttttgggatgaaattgttttattttagattataaggtattagatttttataagaagtgtataatttagattttttgtattatttgtatgggtagtttataatagagtttgtgtttttgtgagaatttaatgttgttattgatttgataggagtttaggtagtaatgtttgtttgtattttgtttattttttgttgtgtggttttttttttaataggttatagatttatattatttggtagtttggggttttgggatttttgttttagagtttttaaattttataaatattttttttaggaatagttagttttatgttttgatagaatggattttttaggttgtgatttgatattagaatttatataaggatttatgtataaagaatgtatttgatatttttttttatttttttttaaattattattttttttaattttatttatattaagttaaaatttttatagtgtttaatgttagtaaaaatggtattgtgttttaggttagattattaattttttttatattgttattttatttattattgtgttgaaagttttattgattatgtaagttgttataatttttttggaagtattagtgtttatataatgaaaaattaagtaggtgaataatgtatgagttagtatttagttttttatttgttttgaatgagttaagagatttagatattattttgaaagttataataaatagtaatatgattatatttagtttttttttaaaatgatatagatgtaataaaatgaaggaaggatattttgaaaatgtttttttgatttttttttaagtttttttaaggatgtatgttatatgtttggtttttagtaaaggtatttggtttttaggtttttttaaagttgtaagttttattgaagttgtattgtattgagttatatatgatggttttatattatagtttagatattttagggtattaggtgtgtttttttttttttttttttagtaatagtagggattggttataaaggagaaaaattatttttttttttatggattaattgtttttttaaataaaataattaaatatagtataagaatataatgtaattatatttgtgatagatttaaattattaaggtaatgaattattaaaagaaaatatttttgtggagttaaaaggattaataaatattagtgtggttgtattattaaatattggattaagaattgaagaatttgaatttagttttttgagattttagataaatggtttaatttttttaagttttaggttattgattattaaaatggggattagtaatatttggttttattaattgttaaattgtttatgaagtataagtgaaatattttttgaattgtttataatttttatatttatttaaaaaaggtgtaaagattaagaaggtaaatttaatattagtaataataagaaaatttatatatttgattaataagggtgattttatttgattaatatatatgtaaagttagttatttagggaaagtaaaatataaataaatgtaataaatatattaatgattgattttaaaagaagtatattatagtttggaaattatagtgaattttttaattaatttttgtaaaattgatttataattatgttttaattgagtttattttttgatttttttaatagtaattatggagtttggttgtaattgattaggagaaataaaggtaattgtgttagttattatattagggtttttaatttatttttaaattatttgaagaatttttattaaggggattgagtttatataaaatatggaatgttaataatatttttttaattatttttgtagtaattgttaatgtataataatatattaaataaataatagtgatttgtattattaaaataaggatttttaattttttagtatgttatatgtagttaaagttaaataaatttaaataaggaaaagattttttttttaaagtttgtgagatatagaatattattttagtgagatatatatatggtatatatagtatatatatagtatatatagtatatatgtattttattaaatatatatattttattgtattttgtgaaatatagaatattattttagtgagatttatatatatatatgtgggtattatatatatatgtagttaagaattaattttaattaattttttagaaaatgatattgatgtatatttgtaaatgtttgtatttttagtattataatttatgtttgttgagttaattttatttaatttgaaattgtgatttttatataggtatttaataatttgttaattttttttgaattttttttttatggatatgttttgtaaatttatttatattgtttattatgaaattaatttatgataaatttttgtttattttatatttttttaaagattgttagtttgtatttatttggtttgaagtttttatagattaggttatagttatttttttttttttttgattttttagatatgaatttgaattgatttattattttttagttattatgttagatgtattttaaatagtgttttgtagggttatttagaaggagttttggtaaaaggagtgagtagttattgaaagttttatttttttatatgttataaaataaaatggatttgttaaagttttttatttgtttttttattattttttgtattaaaaaaaaaagtttttagaagatgtagatttagtttgaattttttattgtttttattttaattgatataaataaaattatttagtgatgatattaaaatatgagttagtttttataagttgtatgattagatgaataagtataaatagtttttgtattttttagttgtttatgagattatggttggtgtagatttgtattaagtgatttgaggggtttttttaattgttagtgggagttgtggataaggatatttatttatttttgtattattattgtattaaatttaagttaattataaatgattagtttttattttatttttttttattttgaaatttaaaatattatttttttggtataaatggtgtttgtttggtattttgaggtttataaaaattatttgattggtatgaaatgatttatttttatttaattgttttgaatagggaattatttttatttagataatttttagattttagggtatgaaatggaagtatttttgttgggattttgattgggattgtatttattgtgtagtgaatttttatttgttataaattaaggatttttttaaagtttttgagtagatttttgatagtggtagtaattgggattttggattaaaggtggtaatagagtttttatgtgttttgagattaaataatattttagtaaaattagagtttagaaataggtgtgatttttgtttttagtttgtatatattttttttattttttttttttttttttattgttttggtatttttttagtgtattggggatgaaagttttagtttagaaaaaagtatatatgtgtatatttatatgtgtatatatatgtatttgttttaaattatattttataaaggagtaggtaatttgtatgaaatatgtagttaaaaaggaagttttatttatattttgagattttgttgggatatttattttttagttatttttagtttttttggggttagttttgttagagaattatatgtttatttttgttaaaataataaaattatatttgtaaagttgttatttatatttttttttttttttattgttattagttaggtttaggtttattttgattatgtatagtaaattaattattgtgatgtgggttttgtagaagagaaatttatttatatagatatttagtaaggaggtaggagtatattttttaaatttgtttttttaaagataaggtttagtgatatttatgagttagggaagtggggtggtttaaggtatggggaaaggtgatttgtagtggggaaaaatgaagtaatgggtttattttgtgtaagtatagttaggattgatggtattttataggatatatgtatagaaaatggtagtattagtataatttgagggttaagttttgggttttttgaggtgaaaaggatatttttttggtgtttgtataggttttaagttgaaggttaggtggttttaattggtttgaattggataggagttggtttaagtttttgaaaaataaataaattaattattattatggtgattaatggatgttgtttgtaaagtaattagtgaaggttaagttttagtatttagtagagaggtttttagttatagtggtttttagttttatggaaaaaagaaaaagaataataataataataaaaagtaagttagtgaaagtaaatagggttgttagatttgattaaattaattttttggtttttttatagttatttagttatatttaaggttggtatgaaagttatttttttttttattttatagatgaggaaatgtttagagaagttggtttttgggttgattagtaatgtttggttttaaatttggttggttttttttgggattagtgtttttttaggtatttggtatgattgtggtttggtttttaagttttttattagattttttatatattatttatttatttaaaaatgtttattagtattttaagaattttgtgtgttgttttttttttttagtgttatatttttttaattttaaatggtatattttttttattattaaaattaatgttttaatggtatttttttttaaaatttgagaataaattgatttaatagttgatgttatagaaatgaggaagaataatatttgtgttttattattatgtttagaaaatttattatatgttttgaattttttttttttttatttttgaaaaaaatgtttgtttttgtgtgaaaattttatgtattttagttattattatttttatttttataatttttttttattaatttttatgattttaaatttattttttaagttatttagtttttttaagaaataatttttattgtatagttttttttttattttgagagaatttgatttagtatttattagttttttaaatgattttgttaaatagttattgaggttttttaataatggttggatttattggaatgtattttttttattgtgttaatataaatattattttgtttttaaatttatttatattttatgatattttgttagtattttttagttttggtatgaaaaataatatgtaagaaattaagttttataattttttgttgattttttttgtttttgttttaattgttggaggttttgttattagatatgataggatttgagtagagtgaaattaaggttgaaaaaaaattgaatgtttgaattattgattttaagagtaagagggaaggaagaagtggaaagtattttaaaatattatgtttaaaggattatggagtttaaaattttagtataaagaattgaagtgaaattaatggttttattattagtggattaattaaagtattgaataggagattaagattggatttttgttgaatgaattttgtttatatgagaaaagttagtgaaagatttaattgaatgtttaatttaaggtattttttgtatttgatttgtgatattaaaattgtttttaatatgtgatggttatgtttatattgttttagtttggttttattaatttatttattatttatttatttaatatttattatttgtaagatattgtgataaataagtgatatataagataaataagagatatataagataaataagagatatataatttttttttttttttttatagattgtagtttattgggaaatttgggtaataaaataggtaattataatgaaggttatagttttgatattaggagttagtttagttttttttttagttttatttgtttttttttttaagtttttttgtttttattttttgtttaaatagttttgattatattaagttattttgaataattttaaaaaatgtaggaagatatatagtttattgattatatgttttagtagtgaaaaaatgtgtttatgtatatttgttttggaatgaagttttttgtatttttaaatttataataattttttaaatatttttttagttttttttaatattttttttatagtattttagattaaaatgattgattttagagatttttattaaatattttttaatttatttttattgtatgttaggtattatgttattttttaaggatataatgataagtaaatagataggttgatatgttatttatatttaggaagtttatagtttagtggtaaatatatatattaaattaaaaatatgtaaatgataagttagtttgttatatatgttaatagggaaattgtaagagtatagaatttttttatgggataaaagtgagtgggagagaatttagatgaatgtgaaaagattgatttttggtgaaagtttgatttattttgaattttgaagaataaagatttatttaagatataatatgggggaataattagttatttttatatttttatatttagttttattttattttatatttttagatttaaaagtttggttatggttttttaaagatgtgaattattttaagtttttaagttaagattttgtgtttttaaatttggattagaaattagttggagaaataagaaaagaaaaaaaagattgttatgtaaatgtttaattatttaaaatatgaggatttaaggagttaaaggtagattagtaagtgaaagttttttatttttgttaatattttttattttaaattggaagttatgtgttatgataatataagaagaggatttttaatttagagtaggagagttaaggaatatattttaaagtaattgattttagaattgagatttaagtgataattaggagttaattagaagagtagatggtggaaggagaaaaagtggaggaagatagtttagaggagttagggagttaagaaagaagaggaatttgagaatgagtttagaggtaagagggttgaaaagttttgtagtttagtatttggagggtgttggtataggggaatagtggtaatgtgttattggggaggtgatagggaaggtaatgagagatttttagattgtattaagaagataagtgatttgattgaatttttgtttgtaagaaagttttggttattgttgtgaaaatatttttgagtgaggtatgattgtgaagtagaaagaatattagagggtagtgtagtaattttggatagaaatattaatgatttagtttagtggttattaaattttgttttttaaatatttttaaaataattttgtaaaattgtatattattttatatatttgtgaattgatataaatatttattataagtttaaattgttgtaaaatgtaatttttagtatattgtaaattttgttattttaaattgtttgttgtattatttttaatagtatttattagagtttgaataatattgagatttaatgtttgttattatttatttaaaaatatttgatatattttttgtataattttaaaaattttgtgttatttttttttttttaatttttatttttatttttatggattttatttttttattatatattatatgtttaaaagtatttaattatttaataatgtattttagttataaaatggttataatttaattttaaatattttttataaggttttaagtgttaattatttttttagaatgagttgttaataaaatttttattattgaatatttgaataaatttatataattatattttaaattttgaaaaaattgttattgataaaagaagtataattttattggtaatgtatagtttaatgtaatagatgggtttttaaaattttaatttttttatttttgggagaatgttatttattgttaaaattagatagagtttaatattaattttgttttgaatttgatttattgttaaaaattatttttaataaatttaattttgttgaatgtaaagaaatggaaattgtttgatttatgaaataatttagttgttagttatttatttttttaatagttatattagtattttttaatatttatattagttatttttttgtttggtgtttttaaagagtttatatgtttaattaatgtatattaaattttgggtgggtgagaagtatgttttttttttgtaaaataagaggaaggtaattaggaaagagggagttggaaagtagagtttgtatttgtgtttgaagatagagttgaagataaatgtattttaagttaattatttaaaatttttttttaagtataatttggaaggatttgtatgtttttaggaatatatatatattagtttaaagattatttagatagattgaggtagtgataatgatagtagaaaaaagtggaaagatattagaaagaaagagaaatataaggtgaaaaatttaataaatttttgtattgtgttagattggtagtatgtataaaagttttagaagttaataagagtgggttatattttaaatatttttttggagagtagaaaattgttgagtagggaaatagaatgatttgtttggtatttggagataatgagtttatagggttgatttgtaaggttgtataattttttttgtagttattagttataagggtgaagatgtagagaaagtataaagttgagggttttgtgtgttaattttagaaagttgattttgagggatagtgaattattatgaatgaaaattgataaattttaatttttttgggtaagataaattaaaagtggatttaaatagaggaatgtatgtgtagtagtaaggaagatttgttaaagtatgttaggtagggaaaagaatttgaggaaaaagtttagtagtaggaggtttgggatgttttgtaaggttgattttgaggtaatttatatataaaaataatttgagaatgtatagttttgagaaataatttttgtagattaaagtaaagaaagttgttataaaaataattagaatgatatttaggagataaagttttggaatattttagattttttttttttaatgttttataaatatatatttaaagtaattatataatatataatatattggatattatattatttgaaattattgatatatatattaataagagtttagatgttaatgtataatatgtaaaggggtatataattttttaagggggttttgtaggtaaaaattttgaagattattgaaatgaagtattgagaattagaagtagaaatttagagataatgatgtttgtttagatgttggggaatatgtgatgttgaaggttggtgttggtagatttagagttaattttaataataaatttatataatttttttaaagaattgtatgattatgagtattttaaaggtgtttattaaataagttattttaagaatttggtagggttgttgaaaatagtaaaggtagtatgggtaggtaatattttttttagtggaaaagaatttgataaatttatttttattattatattttagtttgtagaggtttgtgggtagtggagatgttttaggaattttgatgaaagttgatagagaaagtagtttggggttagaaatatttatatttttaaattatttataagaaatgaatgatttgaaagtaggtgggtttttagaaaatagatagaattatggtgttgttttagtagagaaatgaagttgttttttgtggaaaaagttaagttagaattttgatgttttttagtaaaatagtattaaattgatgaattaaatttttttaaatgtgtttttgtatatttatataaaagaaaattttggaaaagttagttattgttattttttaggtataaaaagttgagttttgtatatatagttttttatatttttagagatagtttaggttttaaataggatttggttagtttttttgattttttgtatgaatttgtaagtttttttgtgttttgttttttttgtttttggtagtggtggtggtgggatattattttttaattttgtgtatatattgttataaatttagtaattgttaaaatatatttggttattttaatttttttgggttaggagtatgggtatagtttagttggatttttggtttagaattttataaggttgaagttaagtttggttgggttgtgtttttttttggagtttggtgtttttttttagttgttagtagaatttagtgttttgtagttataggattaaggttttgattttttgttgttagttttgagaggttattttttattttttgttttttttattgtatttttatttggttttttttaatatagtagtttatttttttaaggttagtaggagattttttttttttttggaagggtttaagtttttttttaaggatttttatttgattaagattagtttatttagaataattttttttttaattaagtgagaattaatttatttgagattttaattaagattaataaataatatgaaaaaaagttgaatattatagattattagagaaatgtaaattaaaattataatgagatattattttatgttagttagaagggtaattattaaaaaagttaagaaataatagatgttggagaggttatggagatgttggtgggaatgtaaattaatttaattattgtggaagatggtgtggtgattttttaaagatttagaattagaaatattatttgatttagtaattttattattgtatatatatttaaaggattattaatttttttattatagaaatatatgtatatgtatgtttattgtagtattatttataatagtaaagatagggaattaatttaaatttttaatagtgatagattggataaagaaaatgtggtatatatatattatggaatattatgtagttataagaaggaataagattatgttttttgtggggatatggatagagttgtaagttattgtttttagtaaattaatgtaagaatggaaaattaaatattgaatgttgttatttagaagtgagggttgaataatgagaatatatggatatagggaggggaataatatatattggggtttgttagagggtggggttgggggagggagagtattaggaaaaatagttaatgtattttgggtttaatatttaggtgatgggttgataggtgtagtaaattattatggtatatgttgatttatgtaatagatttgtatgttttatatatgtattttagaatttaaaataaatataaaaaatttaaaatagatataaagaggagatgatggtgaaaggggatgaaaaggttaaagaatatggagaatagatttataagtaggtaaaataaatgattaatagattaatagttttagaaggtgagaatagaattgagagatgaggagaggggtaaattatggattttagttaataaatattaatattggtttattaattgtaataaaagttttatattaatgtaagatgtaggatataaaagataagataatagtggaaattgtgtgggtagatgaagggggtatatgggaatttatttgatttttttattataatttttttgtaaatttaaaattgtttttaaaaagttattaaaataaataagtaaataaattgtgtaatggaaaaaaaaataatgataaaaagattttttttttttgtatttttgttatatagtatttttttatttttgtgtaatttaatatagagagtaatattttattatattgatagtttttatttatatttaagggaagaattaataggagtattatgttgggggttagggtaagaattttgagattttataattttgtttattataggagtgaagggtatagaattatagtgatatttgattatttatattttgttattttattataaaattatttgatttaagttttaataaatttttattaatgttaatgtttttaatttggtttgtttaaataatttattatttaaaatttttttatttttaatatttaaaattgaagattgttttttatagttgatgttagtaaaaaatttattaatataattattaattatatttttttaaaatttttttaattatattgttttttttgaaatagaatatttattattttatatattatatttgaagtttttatttgttataaattttataagatttttatattttttttaattttttatataatattgattagaaattggatttttaaatttattaggtttaatttaatagataaaatttatttttataaatatatattgtatattttattagttagttagtttgttaggatataaaattgaaaaagattattttgtttttaaatagtttgtgaaaaattttttgatgatatattaggataatttttaatattttgtttggatgttttttaaggtttggtgtaatatgtgtgatgttttttttaataatatttatttagttttgattttttggatattaattgggtgtttaataatttaatttaattgtgtttttaatttattggagttagtgtagattttataggttaatggtttagttttataagattgttttttattttagatgttagttgtaagttttaagttttttgtatttttgattaatgggttataaattgtaggtttttatgatattttatataggtttaataaattgttgtaatgttttatagaatttaaaagaatgttatttattattattagtttattatgatggatgtaatttaaaaatagttaaagggaggagatatgtagggtaagtatgggataaggggtaggagtttttatattttttttaggtatgttatttttttagtaattttatgtgtttgttaatatggaagttttgtaaattttagtatttagggattttaatggaaagttattatttatatatgatttattggttattggtagaaagtttgaggtggggttgagagttttaaatttttaattaaggtttggtatttttggtaattagtttttttattttgaagttatttaggggtttataaagagttattttattattataaaagatatttttattatttttaatatttaggaaattttaaaagttttaggagttttgtgttaggaataggggataaagattaaatatttatgttattatttagggtaatgtaattattaatttagaaattattattgtataatataatttaaattattttggaaagaaatatatggttattttaaagttaattgaagtttatttgttaatttaaagaatatattatatttttttgatatttgttttaattgagttggtttgtttatgttaagtttttttttttttttgtagatttaagtgttttggttgtatttgttttagtttatttataaaatattagatgaaatgttttatttaatgtttttagtattaatttttagggaattttgattaaaagttttttatttagaaaaaaatatatatttatgtttaaatttgtttgtttaaaaaaaaagtagaaatgttttttaagtatttagtgaaatatttttaaagttttttaatggaattttgttttataaattaagaaaataagtgtaagtaatttttattagttttttttttttttgattttttttttttttagttagagattatttaggaatgtattttttttttgaaatattgttggattgttttttagtgtattattttattgtagaagtgagatttatttattttataataatttttaagaattgttttgtgtttatttatatttattaatttttttaaaagaattttttttaaaaaagttatttttagtttatttattaattttttattggttttttttgagtttataatatgtatttttatttaattatttttgaataatattatgttattttttatatagtataattatttttataatagtgtatttttagttttttttgttgttattgttattgttgttatatatggtatttttatttatgttttaaattttataatatattgttattatttttgttttagatagtgaatttttttttatagtaattataaattaggaaaaagtgggagggttgtttgaggttaggagtttgagggttaggagtttgagattagtttgggtagttgagtgaggtttttgtttttataaaaataaagaaaaaaaaaaatagttgggttgtatttagttttttagaagtttgatgtggaataattatttgtgtttaggagtttgaggttgtagtgatttatgattgtattattgtattttagtttgggtgatagagtgagattttgttttttaatatatatatatatatatatatatatatatgaaatattttttttatttattttatttttatttttttgattttttttatttttttttgtagatttaggttgtgtttagtgttatattttttttgttgtgtagtttagtttttaataggttatggattggtattagtttattgttttttatattttttaaaatgtgggtttttttttatggggtttatagaggttattgattttttttgtagtttgataaaaataaaatgttatatgtgttttttttttttttggagaggtttggttttttttgttatttaggttatttggtggttttataattttaggtttttgatatatttaaggaaagttatgaatattatttggttttttttatattgttatatagaggtgagattttttgaagtttttagtatttaatgtagaagtagaagtttatttataatttatttttttagtgattgtatgttgtattgttaatgtaaaggttatgaaaaaaatttttttgttattttatgaatttaatatttttttttgaattgggtaaagatttttttttttattgaatttgttttaatattaagttatatttgtaatttttataaatattgaatatatgtttattgaaagttatagagtaaattggtttttttttttattttattttaattgtatatataatattttgaaatttattattattataaattagaagtatttttatatttattaaatatttatattttttttttattttattaaatgaagatgtattaaagaaagtatgttttaattttagttatttaaaatatagttattatatatttgttgttttataggtattgaggaagatgtttatgagagtattgttttaatgataaaaattgggtttagggattttgatattttatgaatttaaaatgataattttagaattattgttaaatagaattgtaggaagtatattatgtttaatgttggattgttagaggttttgaattaatgtttatgaatataagatttatttatgatatttaagaaagttaaaattgttgggattttttttttatatattgttattttagttaaaatataattgatgaatagataatttataattttaattttaaaatattgtaattttgtattagatagaataggttaagataaaataggtaataattgtattaataaatatttataaaattttaagtatttgatatagtaaaggtttattggttatttatattatagttaaatgtattaatattttattttttaatttatgtatagtaaataatttttaaggattttttgtagtaggagtttttagtttttgggtagtagattggtattagtttgtgatttgttagaaattgggttgtatagtaggaggtgagtagtagatgtgtaaatattattatttgagttttattttttgttaatagtagtattagatttttataggagttggaattttattataaattgtgtatgtgagggatttagattgtgagttttttatgagaatttaatgtttgatgatttgtggaatagttttattttgaaattatttttttttatttgtggaaaaattgttttttataaaattgggatttggtgttaaagagattggggattgttgttgtatagaataataaagggttggaggattaggtgggatttggattgatttttttttttttttttttttttttttttttttttttttttttttttttttttttttttttttttttttttttttttgttttttttttttttttttttttttgttttttttttttttttttttttttttgatagagttttgtttttgttgtttaggttggagtgtaatggtgtgattttggtttattgtaatttttgttttttaggtttaagtgatttttttttagtttttgagtatttggggttataggagtttgttattatgtttagttaattttttgtatttttagtagagatagggggttttattatgttggttaggttggttttgaatttttgattttaggtgatttatttgttttggttttttaaagtgttgggattataggtgtgaattattatgtttagatttattttttttttttttttaataattttattgagatattatttatatattttataatttatttatttaaagtgtataatttattgatttatagttgtgtaattattaatttaattttagaatatttttattttttaaaagaaattttataagtgttggttttattttgtttttattttttttttttatttttgagtaattattaatttattttttatttttatgatttatttattttggatattttatgtgaatgaaattgtattatatgattttatattttttgtgaatttttttttatttagtataatgtttttaaggtttattgatattgtattatgtaaaattattttatttttttttattattgtataatattttattgtataaatatattattttttttgtatttgtttattagttgatggatatttgagttgtttatgttttttggttattatgaataatgtagtaatgattatttgtaagttttgtgtagatatatgtttttattttttttatgtatataattaagggtggaattgttggggtatatggtaattttatttttaaatttggaggtaaagttattattaaattgttttttaaagtaatagtattatttttatatttttattagtatgaataaaggtttttttttttttatatttttattaaaatttttttttgttttttttattaaagttattatagtgggtgtgaagtaatagtttattgtgggtttgatttgtatttttataatgagtaatgatagtaatgatttggatgtttttttatgtgattattgtttatttgtgtattttttttggagaaatatttttttaaattttttgtttatttatttaattgggatttttgtttttttaagtattgagttataagagtttttttataattttggatataagttatttattagatatatgttttgtaaatattttgtgttattttgtgagtagtttttttatttttttgatgatatattttgatgtttaaaagtttttaattttaatgaagtttaattttatttttgtttttgttgttgatgttttttgtattttatgtaagaaattttggtttaatttgtggttaaagatttatttttatgtttttttttaagaaatatataattttagtttttatatttagatttatgatttattttgaattatttttttggtatggtgtgaagtaggggtttaaatttattttttttgtatttgaatatttagttgttttagtattatatatttattgaattgtttttatattttttttaaaatttattgattataagggtaaaggtttatttttatattttgaattttgttttattgatttatatgtttattattattaagattatattgttttgattattgttattttgtagtgaatttgaaatttagaattgtgaattttttattttgtgtttttttttagtatttttttggatattttgggttttttggatttttatattaattttaagattggtttgttaaaatttgtaaaaaagttaggtgaaattttgaaagggattatatttaatttgtagaatatttttgggaatattgatatgtaaaatatattaagttttttgaataatgaatataagatgattttttattaatttaggttttttgttttttaaataatgttttgtagtttttagtgtaaattttttgtattttttttattaaatttttttttaagtatgttatttgttttggtgttattgtaaatttaattatttttaaattgtatttttagattgtttattgtaagtatatagaatatgattattttttgtatatttattatttattttgaaattttgttgaatttatttattagttataatttttttagtggattttttagaattttttaaatataagattatgttatttgttaataaaaatagttttattttttttttttaatttgggtttattttatttttattttttatttatttgttttgtttagaatttttagtaaaatgtttagtagaagtggtgaaagagatatttttgttttatttttgattatatgggaaaagtatttagtaatttatttttaatataatgttagtagtggattttgtgttgatgttttttattaagttgggaaagtttttttttatttttagtttagtaagtatttttattataaaaagtgttggagtttgttaaatgttttttttatatttatgtagggtgattatatggtttttgttttttattttattaatatgatgtattgtattaattgatttttggattttaaattaatattgtgttattgggaaaaattttatttggttatgatgtataattttttttatttatttagttagatttagtttgttaatattttgttgataatttttatatttgtggattttatttatttgtttatttttttatatattttatattgataattagatgttttagataataatattatagtaattttggatattgatttttttattttgttattgttattgttgtttagtttttggttatttgtgtatttgttttgtgatttagttgaaataattttgtgaagtttttttgtgtaggatgtttttaagggttaggtttaaaagttatatatattatttttgttttaattttaaatgttagaatttggatatgtggtttatatttaattgtaagagaagttgggagatgtagataagtatagtgttatttggtgagtattagaagtttttattattatttaaatttttagttattaaatattttttttttatatttaatgtattttgttgtttaaggagtttaattgtaaattattgaattttaagttgaagaatttttaagttaggaaatgtatttatttggtttagtgatatagaaattaaaaagataaggtttttttatattttatttgtatttatatatgtttttaatttaaatggtggggtaggggaaagaaaaatatatttattattaataaaatggaaggttggatgatatataatgattattaatttttttatgagatattggttaaaggatataatatgttagttaagtaagaggaataattttaatagtatgggattatagttaataataatgtattgtatttgaaaatttttaagagtttatgttaagtgtttttattataaaaaataataagtatgtgaggtaatgtatatattaattagtttagttgaattattttatagtgtatatatattttaaaatgtgttgtatatggtaagtatatataaattttatttgttaatttaaaaataatttgtttgtagaaatattagaattttttaggatagataatttttgaagtttttttgttttgatagtgagggaagttttttgagatttatttatgttttgttttttaagtatgaatttttttttttatttttttttttattttgaatgaattttttttttttattttgttaaatgtttattaatataaaatggagttatattggtttttttttgtaaagggagagaagatgggttttttgagtttattattattattattattattattattttgttgatatttttggtggtatttttatatttgtgttattgtggttagaaatattattggattatattttagttttgaatttaattttgggatttgttgtaatttttggttttagttttattattggagaaattatttgttttgagaagttaaaagtgttattgagttttaatttattaagattttttagattttattattttttgagataatagtttttattttttttttttatttttatttttaatgtattttttttttttttgggtataagatttttattattataaataaaaataattattttaatggaagttttttatttattagaattaggaggttgtttgaatgttaagttttttttatataaagattattaagattttaatttggatgaaaatttgtaatttgtaagtaaaattttaaagtaaagtttttaatttagtttgttaaatgggattatagaggattatatttttggtagatgggagtagagatttaggttgagttagtatttatgtggtttaatttgaatttgaatttagaatgttagaggaatagttgttataataatttttataaagtttataaaagggtaattaaggatgttgaaaattgattttagtagtagtatttttttattttttatttttatggatttaatttttttgttttttgtgttagttttttggaattatttttatttttttaaaaattgttttttttgttttttttgatgtttttgtatttgttttttttgggtgataggttgttattgattttgtggttgattgtattgtattttagtttgaatatttatttttgataattttatggtttttgtttttatgtgtagttaattataaattttgtgtggattgagattaattgtgttttttttttttagtagttgtaattttatatgttttttgttattggtattgtgttagaaagtaataatagatgttttaaaaagagttgttatatgaataaaattttatttattttttagttttgtttgagttatggattttgaagttagttatttgttatttagaaattttgatattatattgttattatttattttagattttttttagaaatattaaagttaatatttttgtgaaaattgaaaaaaaattttatgattaaatttttattaattttgaataaaatgttatattaaggaatgaatgttttgatagtttataaaatataaaataatattataataatttaagtgatatataataataatttaagtaatattttttaaggtttgatttaaggatataaatatatgtattaaatattgaaaaaaaataaggatgataggatattagatttattattttatttttttttttttgttttttgagatagggtttttgttatttaggttggagtgtagtggagttattatagtttattatagttttgttttttttgggattaagtgatttttttaatttagttgttagagtaagtttggattataggtgtatgttattatgtttggttaatttttgtattttttgtagagataagtgttttattatgttgtttaggttgattttgaatttttgtgtttaagtagtttgtttattttagttttttaaagtgttgggattatatttgtgagttattgtgtttagtttttattttttttttatatatatatattattatagttaatttattagaatgaattatagtttataggaaaatattttgtatatagttttttgataaataatgtttgttattatgttaaatttattgtaaaatttatagtggttttttatattatgttgtttttatggtttgtaaattaaatataaatgaattattagaattattaattattttgtttgttagtgaagatattggaatggaaattattttgagttttaaaggtaaatgatatattttgaagataattattattttttttatttaaaatgtatattgatatggtttggttttgtttatattaaaattttattttgaattgtaatttttataatttttatgtgttgtgggaggaatttggtgggaagtgattgaattatgggggtgggttttttttatgttgtttttatgatagtgagtgggttttataagatttgatggttttaaaagtgggagtttttttgtataagtttttttgtttgttgttatgtgagatgtgtttttattttttattatgattgtgaggttttttagttatgtggaattttaagtttaataaattttttttttttttttttaaattgtttagttttgggtatgtttttattagtagtataaaaattgattaatatatataggttttattagaattatttaaagaataaagtaaaaatattaatataaaatgattgagttattggaaaatgggattatttatggtagaatttgttgtaataaaagatttttttgttaaaattgttattttatttgggattttttttttaatttttaaggtaaaaataagataatttatatgtatagtttaatttgtagtttagggagatttggtatataattttagttataatgtttattttaatttttatttttttgatataaggtatttaattagatagataatagatttttatttttaaatttaatatttttggtagttttgggtagtattttttggagggaaattaataaattaaattttaattagtatttattgagtatttgttaatatagatgttatggtagggaaaggttatgggtgaaggaatgatagaggtttatgagatattgttgttgatttaaagaaatttttatgtagaatagatgtatataagatatatgtatgtatatatatatatattaatttaaatatattgttatatataaataaataaaaagtttattattgttgagtttggttagtttataaatggttggtttgagtggaaagattaatgagaattatagtatttttggtttgtagatgtttttattttgtgttatatagagttagtaaataagtatttaagaataaaagtgagtgaatagatgtagtttttttttgaagtatatttgaattttgtgttttgtttatttggaggagagagatgagtgaggattttgttaggatagataaatataaattattgttttataattttttattttttggaataattttaattaatattttttttgttattataaaagataattttttgttgggagttagttatgtaattagtgagaaatttttaagtagtgatttggatttgttatagagaaaaaaaaaaaaaaaaaaaaaaaaaaaatagaagaagtagttagaggatgataaatatagggtatggtattttgtgttatgtttaggaagtaggttggagttgagatagattgaatattatgggatttatataatatttaattgtaataagtttttattgtatgattttagggagaggagaagtatggtttattttttaaaagattattttaagtaattttatagagagtagattatagggaggttagttgggaggtttggattatagtagtagtggaaatatggggtaaagtggttggatttgggatattttgaagttagattttaaatattttgttaatagattggatattaatggagagaagaaggataattagtaatttttgttttgtgtttgattaattgagtgaatgttagttttattttttgaaatgatttttaaagagatagaggaagaggtaaaatgttttgtataaaatgttaaggttatattttgtattttatatttttaaaatagaattaatttggttaaaaatgattatgtttaatggagtgagttagattaatttgtataattttaagataatttgaatatttatttgttattttttttttggttggaggttattgttggtggtggtagtttgatagaaaaaatgtagattttttggttaattatgagaaggaaaaatttgatatagaaaaaatttggtttattgagtgatttttagaaatggaaggtatttttatttttttaaaatgtgaatttatatttgttttttgtttattattgaatgagattggatagtttttgagaggaaatgataaaaaattatttttatttttatggggttttttttttgaagttattttggaagttatttattgtgaattttgattttatagtaggagaaaattgagttattataaatattaaatgaattttaaaaagattttatatatttaattagttagtatagattttgagtttaagagattttggtagggtttttttgttgttttgtttgtgtgtgtgtgtgtgtgtgtgtgtgtgtgtgtgtgtgtgtgtgtgtgttttttttattatgatatagaaaattataattattatttataaaattaaaaatttttagtgtatagttatgttaagtgtaataaattaatattaagtattaaaattattaaatgaatttgtgtggatttaaataaaggtttttataatataaatgaaatgttttgtttattttgttttgagtatttttaattatatagttattttgagagggtttagtgaaatgtttttgatatttaaatggtttttgaaatattgattatattgtttataataatagtttgtattgtatgtattaagtattttttttttttttttttttttttttttttgagatggagtttggttgttatttaggttggagtgtagtggtgttattttggtttattgtaattttagttttttgggtttaagtaatttttttgttttagttttttgagtagttgagattataggtgtatattattatgtttagataatttgtgtagagatggggttttattatattggttaggttggttttgaatttttgattttgtgatttatttattttggttttttaaaatgttgggattatagttgtgaattattgtgtttagttgtattaagtatttttatagttatttttttgttgtatatttatagtaattttatgaatttggtattattattattttattttaaaaaatgtataaatttaggttgagaggaaagataattgttttaaattataagaaggtaagtagtttatttaggatttaaattttagttaggttgatattaattttatgttgttgtttatttttttttgtaattttagtagttagtaatttaataaaagtattataattatgtgattaaatttttatagaaagtggaatatattataatgaagatagagaggtattaggtaagaaatagaaaatgtttaagtaaaaattttaaaaagtgttataagatatataaattattttaatttttttatatataaattgtaagaattattattagtatatatttttgaaaattttagtaatttgattttttgttatattatatattatatgtaatgaaatatggtgtattataaaatgtataagatataagtttaatttatgttttaaaggatagttataattttttttattgaatataattttgatagagtttttttgggttaagtttttgattataatatatgtattttaaaatataatatagattttttatattggtttgattgttaaaatattttttaaattaaaatatgtaaaatttgagtaatttttttttgttttttttaaatgtttttgttaaagttttagtgtgttaggttaaaggatatttataatgatatgaaaagttttaatatatgtttttgtagtttatgatatttgtttaaggattttttttttagaatataatataattttaagatgtattaatatgttttaaaggttatatttgtaaaaatttaaaatataatttaattttaaatttttttatttttttattttttatatttttttttgttagtttattattttgtagattaaaaatttgtaatggttttttattgtttttaaattaaatatgtaataatagttattaattattggaatatttgttgtgtattgggttttttagtatattattttttatttttttaattatttgttatatatagagataggaaaattggagtatagggagttgattttgaaatttatgtttatttgatttgaaaattttgtattttttttattagaaatgatggtattttttatttagtaaatgtttattatgttttaggtattatatttaggagtttgggtttaaattttagttttattatttttaatttatgtatttttgggattattatttaaattttttttgttttagtttttttatttataaaattaggtaaataataataataagagtattttatagggttattgggaggataaaatgaataatttatataaagaatttagtatataatttagtaaatataaatatgtattagttattattatttttattaggaaatattttagatatataaaaatttataatgataataaatattaaagttataatgaaatttaaaggatagaatattataaatataattggagtatatgttattttgtagtttagtatttattttttttgtgtatgtttttgtttttttattatagatgtgtatattattttatagatgtttaaattataaagtaatatatagaaatatttttaaattttttaatggatgagattaattgtattttttttgtaatttgttttttatgataaatatgatgtttgtaaaatttattataattgataaatgaggttttagtttatttatttttattgttatgtattatttatgaatgaaattgtagtgaaattagaataagtttattgtaggaatgaaattatagtttatttatttatgttattattgatgtatatttaggtgtgttttaaaatttatattattttataaattgttatagtataataaatgatgataaaaataatataaaatattttttaatgtttattttttaggtaatgatttatatatgttgaattatttaattttataaaattttataggaagaattattattatttataatgtatagatgaagaaagtgggttaatttgatatatttggtatatggtgtttttggaaataaaaataaggtaattaggttaagatgtagttgttttgattatatgtgtttttgggtatatgtatatataagagtgttttaggattagttttttattttgtttgtatattaggattatttggatatttaaatataatgatttatgtttaaatttttttttagataaattgatttaaaatagttggggattaagtttagatataaatattgtttaatttgatttttaattaaattttttgttttgagataattgtaaatttgtatgttgttgtaatattatttattatttatttagtttgttttagggatattattttgtaaaattatagtaaaatattatatttaggattgatattaatatagttaagattttgaatatttttgttattataatgattttttttgttgtttatttgtatttatatttattttttttttgtttattttttttttaattttttataattagtaattggttttatatttttgtaattttgttattttaggaatgttataatattttatataaatggaaagttaattttaaaaggttgtatattatataatggaattttattatataggattatattataggattttattatatagtgtgggattttattatataggattttattatatatatttttttgggattgattttttttaatttattaaaattttttgtagatttatttaggttgttgtatgtataaatattttattttttttatagtttatagtagattatggtatgtaagtattatagttggtttaaatatttatttgttgaaggatatttggattgtttttaggtttttttggttattaaatataagtttttatgaatatttatttataagtttttgtttgaatgtatgtttgtatttttttggaataaatattaaggaatgtaattattaggttatattatattttgatttatttttgttttttaagtaaattgtgttaattggttaatatttttttttttgattatatttaaaggttaaaaagttagtgtttattttaaggtaatattattttttatttttaataatgattttattattaatatttttaattttgatatgaatattatttttaagaaattggagattataaaatagttataggttaaatattgttgatattatttagtaaaagttaaaaaaaaaaaatttagaaaatagtttaaggttttttaatttatagagtattttataaggaaattaatatttgtatgtaattattttattagttttgtttattagatatggtatgtgagaaagaaaatattttaagtgtttaaatatttttaaaattaaatttaaaaaagtatatttttttaatgagatgtttattgatttgaaattaaagtaataagaatgttttgaagaaaatatatttaataatttgtatagtaaagtgaatatagtgttttatttaaattttatagaattttatgaaaaaattaattaagtaagattggatgatatttatattttagaggtatgttttttatttattggaaatttgattaaattattaatatgattatttttatttttagatatttttaggatattagagttaatgaatataatgttttattaaggagaatatgtttaaataattatagaaattaaatattttattttattattatttaaaaagttgtatgtgtttatttttatattaaaatattttttattaaatatatatgtatatataataattttttttattagttttgtttttttttattttttgtaattagaaatttttttgtttttttgagatagaaatataattgtgtatttgttggataaatattattttttttttttaataaaattttttgatagaagagttttatgttggtattattttaatgaatttaatatatttattaaagaagtggtaagtttaataatatatttgtttttgtgtattatttttttttaaattttgggttatttgtttttgtatattgttttaaaatttaggtatttaagtgtgttattttttattgtaattaattatttggttttgagttgttttaagaattgaattttgttaaaataattgtgagtatgaatttttttgtttgtgagttttttgaataagttggtatattttttttttgataattgttattatttgataatttgttattatagttagattaatattaagatttaagtatttaattttgggtttagtgaaggttaggtatatttagatagttttttatagaaaagtttgaagttaatattttgagtttttttgaattgtatttaataatttttaggttaaaattttaaatggtagaattaaataaatagatttatggtataggttttgagagatgagtaattggagaaagaggtttagatgagattattttttttgaaagtattagtttttattgttatggaggaaagaagatttagatgaatatttatataatttagttttttgtattgtatattatagaaagtttatagagaattttttgggagagtgagttagaaattaaaattaatttgggataatatattatttatttttatattggaatgatttttaaattgtttatttttattgttgttaatgatataagttttttttatgtaatagtttttgaattaaattaagaaaaggtataaatatattgatgaggtttatataatttatgtttaaataattagaataaattattaatggtatttaaaatattttaaaatgtttgttattttaatttgttttttttatattattttatatgtttgtttttttgatatttattttttttgttgttttatttaattataattaggattaaagtttgggaaattgagaagtgatttaaatttattataggtaattatttttttatttttgtttatttgtttttgtaaattttttttttattatttgatgtttaatatattgaagtttttattttgttatttttattttttttttttttattaaagaaatagttttttttttttttttttttttttttttttttttgagatagagttttgtttttgttgtttaggttggagtgtaatggtatgattttggtttatagtaatttttattttttgggttgaagtgatttttttgttttagttttttgagtagttgggattataggtatgtattattaagtttggttaatgttgtatttttagtagagataaagtttttttatgtttgttaggttggttttgaatttttgattttaggtgattgttggttttagttttttaaagtggtgggattataggtgtgagttattgtatttagttaagaaataattaaaaaaaaaaaaagaattttgttttttgattatttatagtaagttataaatagtttataaaattattaaatatatataaaaataaattatattttataaagagggtaaaatggtttagatttaatatatagaaagtaagttaattttttttttaattataaatgattgatatgtttaattagttttattatttttaaaaaaattggagtttattatttagaatttatatgaggaaaagtttagataaaaatggtaaatttaaattatttatgtaagatttttatgaatgggtgtgatagtttattatgtgtaatgttattgaattagtagttgtaaaatttttgtttattttttattttttgattttttttaggaagtaataatatatttttgtaatttaatagttattgttatgatttttgaaataggggtttattagagtattttatattttttgagtgatatttaatttttttattttttagattttaatattttgttttatgaaagaattaaagtaagaaatttaagatatgaaaaaatatttatttttaaaggaagagattattttagttgtttgaaggtttatatgtttaatgtattttttatttgttaatgagatttgtttatattatatagtttttaattagttgttttgaattaattttttatagtttatataaaattataatattataaaaataaaattaatatgattgaggagtttgaagggtagtgaggttatatattttagttttggtttatttagagattgattaataggttgtgttttggagttggtttatgtgtaagaattaaattaatgttatggttttttatgttgaaattttaaggtattatgatgattttaattatatatattaaatttattaaatattataaatagtatattttattgtttttttatagaatattggttggtagttttttttgaaaattagttatttattagaattttatttattatttttttaaaggattttttaatattttttttatagttaagtaaaggttatttttttggtatgtgttttttaaagttttttagtttatttaaatattttaagaaaataataaagattttgtttttttaagtaatattagatataaaattttttaaagagaaataaattgagtattttatgttgaattaagaatgttttttttttttttttttttttatatgttatgtaaaatgagttaaatgatggggattaggaatgagaaaaagaaaattaagaaaggagtgagataaaaattaagggtttagtattatattatttaaaaataagatatgtgttaggtagtaaggagggagattatagaaattaattgaaggttgaaataaaaatatgtatagatttgtttttgattttttatgtataggaggaaattatggttttttgtgagaagataggttatgaagtttatagagatatgtaaattttttgttataattaattttatttgtgttatgatttttgttttttgtgaaattttatgtttttgttttttttttttgttgggtatttagaaatttgtattaagataaagaaaaaataggtaatttattaaaagtaagaaatttgtagtgattattgtatgttatatgaaaataaatagtattgttttattaaataagttgaataaagattgtgaaaaatgtttgtagtaatatttttgttttaagaattttagtgttaattgttgtaaggaatataaaatggtgtaatatagagtgtatttttaaggaataaatttatttgaggtgatgtaaagttataaataatgtaaatattatataataaaaagtaaaaagtagattagtaataaggaaaaggtagattatatagtggatatatattatgagtgtatttatttatttaataattattttttgattgttagtaaatttaaaattagttagattttagagatttaaagattattgtgaattggataatttaggaaatttgagtaagaggatttttttttagtaagtttttatgtatgtttgaaggggatgtaggagaatatttttttttaagtggatgtaaatatgtttgttgagtaaatggttataaagaaaataataaagttattaagtttttaggatataatgataaatatttttgtttgtaatgttaagtataaatatatttttgtttaaatgatatagaagtgagaatgttagaaaggagagattttaattattatttaaaatatttgttattggtgttatgtgtaaaaagaaattttatttttaagtaagtagatgatgtagtaaaagattgtgtgttatttagtatttttttgataataagtgttagagaatttagttaaagttgattaagaaaagaataggtttgtattgatatatatgattgaaaagtttagaagtaaatatggttgtatgaatattttggaatatagatgatttaattaggaatttgtttttattttttttttgattttattttttttttaggttttatgatatttttttttttagttttaggtttatatttttaaagtatttagtttggtagaaaagagagggaaattttggtttgtttttgagtaaagttattgtgttttatgtttggaatttttaaggttagaagtttattttttagttaattattggggttaaaatgatggaattatatagatttatttgtagtagattataaatttattttttattttttgtgaatagaagaatttagtaatttagtgttataattggataagtatagaatttatgtgtttttatatatatttatatagaatgagaatggaggaagtttattttttagagaataattgttgtattggaaataagtgtaatgtagaagttttgtaaatttatttaaatatttattttagggtgttgtataatagtattatgttgaaagggttggatgaaagaatatttggagagagaatgaatatgtattatggttataaattgtgtgaatttgagttatatatataaattggaatggaaagggtgatatttatgtgtaaaattttttgaagaatgatttggtagagtttggtgattgtttattagtttatttaatagtagatgtttttatagttatatatattagggttatattatggttagaggtttttaaatttttgtaagttatagtatttttaattttttggttatttttgtatggtatttttttattaaaataaatgattaagaaatatatttaataaatattgattattttagtaggtttttattttgggtattatagttatagttattgatttataaaaatgtgttattattttttaagaaggattagaaaatggaaaatagataagggttttgtagttattagtttagtaatattatatataaaagattattatatttatttatgtagattttgagtaggtgatttgggtttattgttttgtttaaatttttttttatgtgagttttggataatggattttgatttaaaaaatgataaaattgattttatatattagttatgtgtagttggagaagaaattgatttgttttttatatgttaattttagattattttgttttttttgtaaaatgtgatttgtttttgtatatgtttagtgatttaatatgttatttataatttattgtgagtgattagagaatagtgtttttaaaaaattggtttttttggtggggaaggaagagatgaagataggaggatgggggttttaataggtattagatgttgaggggaaggagtatagggattgataggtagaagtagaaaaagaattttttgtaataaatttgggttattttttagttttttaagtattaattttgattatgattggataaggtaataaaagaagtattaggaaaataggtaggtatatggaatgatatagagagaataagttgaattaataagtattttggaatattttaaatgttattagtgatttgttttgattatttagatatgggttaaatatattttattagtatatttatgtttttttttagtttgatttagagattgttatatagaagaaatatgtgttattaataaaaataaaagtagatgatttgaaagttattttagtatgaaaataaatgatatattgttttagattgattttggtttttgatttatttttttagagagttttttgtaaattttttgtaatatgaaatatagaaaattgagttatatgaatatttatttagataattttttttttaagataataggaattagtatttttagaggaaataattttatttggattttttttttttgttgtttattttttaggatttatgttatgtttaattatatgatagagttgaaaatagtagtttatttttattaagtttatttggtgtattttttaagtttaatatgagtattaatatttatgtatatatagttttttattgtaatgttttgaatttaatatattttatatttagtataagtaaaatagtttataatagtaaagattttttaaaattatttttttttttatttgttttgtatatatgaagttttgatttttatattttagtttttttgtggttttattatttgaattgtatatttgatttatttgagtaaatttttttataagttagaatatttaagatgtatttgattgttttttagtaattattttagaatatttatttattattgattttatgttttgtataatatatatgtttttaattaggttatgtgttataattatttgaagatttttttaagtttaaattttaattaagtttgattttaaatagaataattagagttttgaattaggggaggggtatgtttttagatttttaggtgattttaatttgtatttatggttgagaatgatttaatttaagtaatgtttttttaagttaaatgtattttttagttatttgttgattatttttggtattgagaaaaatgaggatgatatagttatggtgtttgtttttttttagtttatatttttgttaattaaaaatattatgaaagttatataattgtgatagagaaatgtaaatgtatttttttaaatttaaagtataagtgttataatattttaaaggaaataagaaaattttagtgatttttgaattgatattttttttttttttttttagttgtttgttatttagtttatatggtttagttataggataagagaaaagtttttaagtattttttatagatgtgaatgtttgatataaaaaaaagatattttggtttaaagaatgttgttaggaaatatagtttgaagatgaatttttttatagagttgttttttattttgtaataagaaagtgtggtggtagtatgtttttatttaaaagtaaaaaaataatttattaattgtgtatttagagggaatttgttataggtttatttaaaatttatttggaaatagttttggtttattatatgtattataatttttaggaatttttttgttttttaattggtgtaaggataaagttgtgagtatataatattttgtttaaataattattataagagaaatgtatttaaatataataatgaatttatgttaatttttgttttaatagtaatttttattaaagtaatatattttttattataggaaaatgtggatatataaaaaatatgttaagataataaggattgtttataatgttatttaagagaaataattatgttttggtgttatttatgttttattttttttaaatatttaaggtatgttggttaattgttgttataggtttgttttgatatattgttatttagtaagtaaaatagtttaatttatttatatttattataattttttatgtattttgatgtatttttaaaattttattttatgtttttttaattatttatttttttttttttttttattttttgttttttatttgattagtttatgtattatgtattattgaggttataatatttaatatttagttttgtatttttatataatttagtataagttttttttgattttgattattataaagtatttgaaagtgtaattttaaggtttttttaatatttttattatattgttttattatatgtaaatatattaaattatttaattagaatagatttttttatgaggaattattgtattaaagtatttgaatatttttaagatatttgatgtatattattaaattattttttgaaaatgttgttttagttattattttttgtagtagtataggaaaatattaattattgtatttatataaatattgagtattgttaattttaatgttgtgtaaattttattaaataaaatatatatatagtattaagttgtattttttatttatatgttatatatgtatgtttatttatgtaagtttagtatgttttttatttattagtttattagtattataatagttttttatatattaattgttgtgagttttttatagttatgtttgtaatttttttgaagtttttttttaatttatattttgtttttaaaatttatttataatttttatatatataatttaaatttttttttttgtatttttttatatttagggagttggtgtatttattttttttttaagtttttgtaagttaatttgatttttatattttgatttttaatttatttgagtttttgttgatatatgaagtgagattagaatgtttattgatttttttttagttatttagttgttttagtgttttttattgagttgtattttatatttttatttgttagtatttttataaatagaggatgtaagtaatataaatgtaagtttggtttaaattttaattttattatttattagtattagaaatattataattttgggtaaattgtttaatttatatgatttaggtgttttatttttaaaatggatataaagaagaatttatatgaaggtttttgtgaggggtgagataatatatgtaaggtgtttggtatataataaatgtttagaaaatgttagtttttatagaatttgtttgttttgtaaagaatattattttttatgaagtttttattatgatttttaattggtgggattatagttattttattagttttgagaaataatttggtagagtatttaagtatatggattttagagttaaattgtttggttgtgaattttaatatgtttattagttaattgtgtgattttagttattttatatttttgtgttttaatttttttatttgtaaaattgagatatttatagtatttattatagagattttttgtgagaattttaatgagaattaaatgtatttatagtggttagtagtaagtgttatgtatgtattagttataatttgttttaaaatagttttaatgttttttttaaatattttttttttttaataaatttgagatttatttttttaagtgtagagaaattttatttgtgttttgattgaaagtatgttattttggaaaattttaagaatattgagttttgttattaggagttggtatagttttttaatttgttaatgttttttttaagtttattaataaatatttatagttttttattttttgtattgattattaaaagtatttttaggttattaattgtgtgtttgttaatattgtaggttgaggttttattttttttatttttaagtagatattgttagtataaaagaaaattatagtttagtttatatttattttttgtttagttattttgttgaatttttaatgtttatattttatttaaatttattttttttgatattttggtttataattatattgtatgtaaaataatagttttgtatttttttttttgattgttgtaaatataatttttgttttattttgaattatatttgtttaagttttaaaatagtgttaaattttgtgtttttagtatggtagaagatattgggataaaaaatagattagatagtgatgggttttgtttttatagtgttttaaatttatttttatggatttaatataatattgatttattaaattttgtgtgttggtttgtattatttaggggagatgttatataatttttattagattattaaaagggtttatggttgtaaaagttaagagttttttattgtagattttggatattagttttttgttagaggagtaggttgtaaaaatttttttttattttgtaggttgtttgtttattttgatggtagttttttttgttgtgtagaagttttttagtttaattagattttatttgttaattttggtttttgttgttattgtttttggtgttttagatatgaagttattgtttatgtttatgttttgaatggtattgtttaggtttttttttagggtttttatggttttaggtttaatatgtaagtttttaatttattttgaattaatttttgtataaggtgtaaggaagggatttagttttagttttttatatatggttagttagtttttttagtattatttattaaatagggaattttttttttattgtttgttttttttaggtttgttaaagattagatagttgtagatatgtggtattaattttgagggttttgttttgttttattgatttatatttttgttttggtattagtattatgttgttttggttattgtagttttgtagtgtagtttgaagttaggtagtgtgatgtttttggttttgtttttttggtttaggattgatttggtaatgtaggtttttttttggttttatatgaattttaaagtagttttttttaattttgtgaagaaagttattggtagtttgatggggatggtattgaatttataaattattttgggtagtatggttatttttatgatattgattttttttatttatgagtatggaatgtttttttatttgtttgtatttttttttattttattgagtagtggtttgtagttttttttgaagaggttttttatgttttttgtaagttggatttttagaatttataagaaaaaaataaaaaattttattaaaaagtgggtgaaggatgtgaatagatattttttaaaagaagatatttatgtagttaaaaaatatatgaaaaaatgtttgttgttattggttattagagatatgtaaattaaaattataatgagatattattttatattatttagaatggtgattattaaaaagttaggaaataataggtgttggagaggatgtggagaaataggaatatttttatattgttggtgggattgtaaattagtttaatttttgtggaagttagtgtggtaattttttagggatttagaattagaaatattatttgatttagttattttattattgggtatatatttaaaggattataaattatgttgttataaagatatatgtatatgtatgtttattgtagtattatttataatagtaaagatttggaattaatttaaatgtttaataatgatagattggattaagaaaatgtggtgtgtatatattatggaatattatgtagttataaaaaatgatgagtttatgttttttgtggggatatggatgaaattggaaattattatttttagtaaattattgtaaggataaaaaattaaatattgtatgtttttatttataggtgggaattgaataatgagaatatgtggatataggaaggggaatattatattttggggattgttgtggggtggggggagggaggagggatagtattaggagatatatttaatgttaaatgatgagttaatgggtgtagtatattaatatggtatatgtatatatatgtaataaatttgtatattgtgtatatgtattttgaaatttaaagtataataataataataaagagttttttattttaatttatagtgataaattagttttattaataatttgattaatttttgtgatgatttatatgtttttatttattgttatggattttttaaaattttaaaataattgtgatagtgttatttatttttttatatgtgtattttatatatatttttaattatttatatttttaaaaaataataattaattttttatagagaaatgttaaaatatgttgaaaataaaaagattttaggtatattaatttatatttttaagagttttattttgagtgtttaaaagtagtattggaaatataatttagtttgtaattatggtttggttatttatggtttttgtaaatataaatataaatatagatatggtttataattttaatttgttttagatttttgattataatgtaaagaaatgtgattaataataataataaaaaaaggaagtatatagaatttggtttttttttgttaggaattaatttttttgtggattgtagaaatattggggaaagatagttgattggtaggaaagatagtaaggtgtttattgggtttgatagagagattatgggtttattttattagtttaataaatagagttaagagtttaataagttgggtggttttttataaataaaataagtttgagagttgtagtaaaaggaagagatttttttttttgatttagtatttaggagataattatttaaaggagggatatttatgtaaagaatatagttttgtttttttttttgttatttggtttattttatagtgttttgttagtgggtgtttaggtttgtgttagggatgtgttttatggagttagttagtagaaattttttgaaagtattttgattgaagttgtaaaaagttgaattatttgaaaatttttttttaggttattttttgtaagggttaaatttgttgttttgggaaatttattttttatttgtatatttgtatttatagtgggagggagattttttaataggttggtgagaagtagttgggtttataattaaaattattgttttttattaattagattttagttataatgttgagtggaaaaaataaagatgggggatgtgataagtgattagaaagaaaataaaataaaattgttaagagttaaatatagtggtttagtttgaatggaattgaaggaaagaaaaggggtaattggaatgttattgtttttttttttagtttttttaatttatttttttatatattttgtataaatattaagtaatttttttagataagtggtatagttataatttttaaaataatttgttaatttatatgtttaggaatttaaaaattgtttattaagtattttttatgtgataggtgttgtggtaggtttttgggtttttgaagttttaaattaatgggagagttagatattgagaattatttaattataaaatgtaatatttatttttaaagaagggtagaaatggtataaattttaatgtattattatgagtattaaaaaaagataatttatataaagaattggtagtgattgtggtagtttatttattatatgtattttagtgatgagaagaattatgaagatgagtattatgttgaggatgaagatgttaggggataggtattgttatttattattattggtaagttgtttgatttttttaaattttattttttgatgtgttagttggagttaataatagttatttatatgtaattttgaagattaaaggtatttgtgaattattggtatttgaaatagtgggtgttttataattgagttattttttttattagatttttatttatgtgatattaatttttaatattatatggatattattaataaaaaagaaatatagatatatgagtggtatattttgagaataatattagatatggattatttttaaggttatttttaaatagagtgaatattattttttttgtgattttttattgtattttatttttttttataattttgttattttttaatagattttaagagttttaggtttatagtaaagttgagtagaaataatagtgagtttttatatattttttgtttttttatatatagttttttttattgttaatattttgtattaaagtggtatagttgttaaaattgatgaatttgtattgatatattattattaattgaagtttttagtttatattagggttatttttgttgttgtatattttatggatttgtatgaatttataatgatagtattatatagaatagttttattgttttaaaaattttttgtgttattgtattttagttttgtgatttttttatttatttttttttttttgttaatttttaggaaatattgattattttattgtttttgtggtgttgttttttttagaatgttatatagttgaaattatatagtatatagtttttttatattgaatttttttatttagtaatatgtatttaagtttttttaatatatttttttggtttgatagtttatttttttttagtgttaaataatattttatggttttgttgtattataggttatttattgatttttttattaaaggatgggttttaatttttggtaattattaattaaggtgttataaatatttttgtgttagtttttgtattgatatatatttttaatttttttgtgtaaatattaaggagtgtgattgttggattatatggtaagaatatgtttaattttgttagaaattgttaaattgtttttttaagtggttgaattattttgtatttttattagtagtaaatgagagtttttgtttttttatattaaatgttagtgaggatatggaatagtaggaattaataatatttggtgttagatttttgttatttgaattggtatgtagtgatatttttttattattttaatgtgtaattttttgatgatatatgatgttgagtatttttttatatattgatttgttatttgtttattttttttggtgagatgtttttttaggaattttgattgttttttagttgagttgtttgtatttttatttttaagttttaagaatttttgtatattttggataatatttttttattagatgtttttataaatatttgtttttgtttatggtttgtttttttttttttttgattgtgttttttgtagagtaggaattttaaattttaatgaagttttgttttgtaattttggtttttatggattttgtttttattgttatattaaagaagtttggattttgtttttattgttatattaaagaagttatttttatatttatttttttttaggttattttgtaggagttttatagttttgtattttaaatttaggtttttgatttattttgagttagtttttgtgaagagtgtaaggtatgtagttaaattttttttgttgttgtgtatggatgtttagttattttaatataatttgttgaaatgattgttttttaattaaattgtttttgtttttttgttaaaagttagttgattatttttatatgattttatatttgaattttttattttgttttattgatttatgtatttgtattttttattagtattatagtattttggtgattatagttttatagtttttatggttttaagttttgaggttggatagtgtttgttttttagttttgttttttttttttaatattttgttgattattttgtttttttatgtaaattttagaattattgttaatgtaaataaaataatttgttgtagttttgattggaattgtattgaatttgtagattaagttgggtagaattgatattttgataattttgaattttttttattatgtttttatttttgtgttttatttaaatatttgtttaaggaaagaataatttgaatttttttatattagagttttgtttaaaatgtttattttttttgttatttttagttttggttaaataattagttggttgtgaaggttgagtaaagatttattattaagaatttgtattgtgagtttgtttgaaggtgaatgatgtatagattggatgtgaatagtaaaaagtgataagaaagatatagttatagtggaaatgagttttttttagggtttaaaatttgttattttgtatattttttaaagtgttgtttttaatggattttgtttgtttgtttgttttgtaaaataatatgtgtattttagatgaatttaggaagttttttattttaagaaaaatattaaattttagttatattagaatttttttatgagaggttgtattaggttattgatttttattaaaataaaaatattaattatagaaaataaaatggaattatttttaaagaaggagatataataagaagagatgaaaaattatagttaaataattattattattggtatattggaaatagtatttgatttagttaagatattgtgttttgataggaatgttaattatgttttaggatataatttgtttaaaaattatatatttatagtttttggaagggaagtttatttttgtaagggtaagagatttgaaatttgaaattttgtaatttttttgttgatagggttggagggtgatttgttaatattttattatataatgtatgttaagagaaatgtaaaggttaaaatatggtgttttttgtttttgttggagtgtttagttagagagatttagtttagtataatattaattattataaatttttttttgaaatttaagatatattaattaaaataaatggaatttaagaaaaatgaaaattggggggggtgaataaataaatatatgattgagttgaaaatataaaaatatttattaaaatattaaaaatattaaatagaaatattttgatgtaatgatttttgatatagtttaaatttaaataaagaatgtatggttatataaaatgtaagtaagtatattattttttatttaaagttttttagttaaatgtaaaatttttttttttattttaattaggtagataattatattattttgtatagttatgttaggagtttaatttttaagttaaattaaaattatttaaaatgttaatgatagtttaaaatttaagaatagaaatttggatatattaaatttaaaattgatgttttattgaaaaaaattaaatgtttttaaattgttataataaattttatatgtttaaaattagttaataaaaataaaagaggataaatttttgtattttttaatttttaaatttttaatatttttattttaagaaattgtagttattgtagtgatatttttttaattttgaaaatatttaggaagtaattttttttaaatgttttattttggtaggaattttagattataagttaaaggtattttttttaaatttgtaaagaaagtaaataatttattaagagaataaatagtttttaatagatatagtttttattgttttttttttttattttgttttttttagttagagagttatgataaaggaaaaataaaataattttagatttatatttttgttgtttttttttttttttttttattttgtttattgtataaaataaattgattaggaggtttttttgttgggttttaaatattattaatatgtagatgatttttaagtagttattttttatttttgtttgatttttaaattttggttttatttatttaaatgtttatttagtatttttatttgaatgtttaatgggaaatttaaatataatatgtttaaaattaaattattggttaatttatttttttattaaaatttaagtttttttttgttgaatagtaatatttttatattttaatagttattttaaaaggtaaatatttatttttgaattttttttttttttttattgtttgttttaatatttttataggtattaagtagttaatgtttattttttattggtttatattttttttgaagttaagaattatattttttggatttgttaaatttttaggatttttaaagattttaaaataaataaaattatttatataatagtttttttatttgttaagtaaatgattatttttatatatttatattgtaagtgatattggtattttattgtattgaagaagttattagattttgaaagataagttttattgtatttttttttttaattgttaaaatttatagtagatatatatgaagagtgaatgttgatttaaattgtgaattttagttaataataatgtattaatattagtttattaattgtaataaattgattatagtaatgtaaaatgttaatggagaaattatataggagagaagggatatatggaaattttttgtattttttgtttaattttttttaagtttaaaattgttttgaaaataatatataaaatatgttatagaaaaaatattttttttattttatgttattgtatttttaagatatttagagatttattttttttttagtttttaatgttttgttttttaatatttaattttttatttaatattttatttattagttgagtatattttatttttttttttataagtgaaaatagataatatataatgttggttttatgaagatttatgaagaaattaattttatgaaataaaaatatttttgaatgagtttattataattgagtggggaatttgagtgttatttttagagaatttggtttatataaatttagttttggtagttagttattaggggtttttgaattggtatatttgagaagtgttttaattttttagtggaataaagaagaggggaaagaatattatagaatgatttttttttttaataaatttttatataaaagggttttgaaagtttggttttaaggtaattttagaaatagattttaaagattgtgatttaagtttttgtgttatagtaagtttaagttttataaagtgttaaattgatgattagttatatggaagtttttatttataatagtatagtttatttttatattatttttaatttgtaaaggtgtttttatatattattttatttggtatttatagttattttgggaaaattgtagaatagatgttaatttttaaatagataattataattttataaagtaaagaaaaagaaatgtatggaagtatttttagtttaattttattagtttattttttattgttttaaaatatttgtaattaggtaagttataaagataagaaatttattttttatagttatggaggttgagaagtttaaggttgaggggttatatttggtgagagtttttttgttggtggggattttgtagagttttgtggtagtagtaatatagggtgttatgtggtgaagggattgtgtgtgtttgggtgtttgtttaggtttttttttttttttttgtagagttattaggtttatttttatgataatttatgaatttattaatttatgaatggattaaaatttaattatttttttaaggttttttttttaaatattgttatgttagggaatgtttttaatatatgaaatttgggggatataagaaaattatagtattaatgttaattatttaatagtaatttttgtgttttaagattttttttttttttttttttgagatggagtttggttttgttgtttaggttggagtgtagtggtgtgattttggtttattgtaagttttgttttttgggtttatgttatttttttgttttagttttttgagtagttgggattataggtggttgttattatgtttagttaatttttttttttttgtatttttttagtagagatggggttttattgtgttagttaagatggttttgattttttgattttgtgatttgtttgttttgattttttaaagtgttgggattataggtgtgagttattgtgtttggttgttttaagattttttaatgaaggtagttgtattgatgtttataggtgttttttttttaattattagttttattttaagatatttaaattttttgaatatatatatatttatatgttgatatatatatgttgatatatgtttatatttatgtatatgtatttattaattatatattgtgtaaagtatttaagttttaataggaatataaagatatgtataaggtatgttttttttttttttttttttagaaatttatagtatagttaggggtaaagagaaatgattataggtattttatatatattttttatataatttttagaagtatgtattatattattatttttattgtataaatattgaaatgatttgtttaaatttattgagttatgtgtattatttttgattagatttatagtttgtatttttgttttttagttttattgttttttgataatataaatatttaaaatgttatgaatataggtttagattttttaggatagttttatagttggttattgtgttttatttattgtttattaagatatattagaaatattaaattttgataaagaaaatatttttttaaaatattttttttttttaattttttaagttgtttttaaatatattttttttaatttagttttttaatatttaattggaagtggttttgtatttaaaaagtaagtaagaatataataataagatattagtaggtgagataaaggattatttgaagatttttgataagggagaagattttagaggaggaggttgtttgaggagatatttttttataaagataaaatttaatttggattttgaaatagagttgaaatttttatttttttatttataaattgaagttaataatagtagttatattatttgtttagatgaaaattgagttaatatttaggtttttaaaatagagtttgatttagaagttggaagatggagtatatatattttaattattaagttaaatgtttttattttttaatttttattgtttagtataatgtttaatatataaaagtatttaatagataattgttgaatgaatgatgaaatgatagtgtattattggtaaattttgagttagagagtatagtaagagaattatagtttttggaggttaaattgatatttgtattgtttattaagttttagagatttggatatatgttttttataataataaatgtttagattgtttttttttggtggaagggattaaaaggtagatttattaagttttttttaaagtttttgtttaattaggtgttaagtttttgaagtttgagaatttgtttttattgttattattaattggggtttgtatgaagtattttatatagtaggtatttaggaagtattgattgattgataagatttggatttgatataaggaaatagttgtttatatttagggagaataattaaagatattagaaattatagaattatttttttttagatattagtttttgtataatatatatttttttttgtaattttatatgattggaggtatgtattgatttttgttttattgataaattaattaatatttgatataaatttgaataaaaaggaataaagttttttgtatagtttaagattgtgttgtggatataagtttgaaattttaatggtttgggggtattaggttaaggtagttttgtaatttttttagtatttgttttggtaatgaaatttttaaaaggagttagaagagtagagtttttataaattaaagtatttaggattaaatattatgatgatatttttttgtagaattatttaataattttttgtgaaagaaataaaagtttaatatatggtatttaaggtgttatgattttaatatattttttttttttaaatatttttatgagtatatgttttagttatgtttattttttaagggtttttgaatttgatttttattatttttttttttttattgttatttttttttggatttgtttgttaagtatggaataataatttgtttttagtaattttttaataaatatatttaatagattttaatggagtatttttgatgtgttaggtattatgttatatgatgtggggggtatagaaaaaggaatgagataatttgttgttgaggagtttgtaatttagaaattttttttttgaataaatttttttgatttattagtatttatgttattgttataatatgtttggatatggtagatatttaagaaatatgtatgtaataaattaataaataattttaaattattatttatttttttttataggattattttgttatatattttttaaagaaaatgtaatgtattttttggtttttgaatgggttttgaataaaaatagatgtttgtatggttaaattgtataattattgagattaatttatatatgttttaaatataaatatttgaatagttttaattgaattgaagtgaatttaatataaaatttttttatgttttttttagaaatgagggtttaaataattttggtatgaattatttattagtttaagtattgatataatgatttgtatttaatgatttttttatttaaaaaatagaatgttaatgattatattatgtttttaggaggattgtattttttatgttgatgttttttaatttgaatagtagttaataggagttatgagattattagttttattttttttttaggggtggttttgtgttagaagatatttagaagttttgtgtatttttagatttgtgaagtggaataaatgtttgatattttaataaagatatttagatattgtgtagtatgtagtagttttgagtattataattttatgtagtagtattaggtagaatgatttagagtggaattttagaaagtatagtggtagtagtgatgaagtttttttattagatgtgggtatttttatagtggagtaaggttatataaagggattattatagtataggaagtttttaaaatttttagggtatattgagtgagtttttggatttggtattatttttttataggttttatttttttatgtttatatgtgagagtaaaagagaaaggagtttgaatattttattttgttgatataggatttttttttgttgtattaaatttaaaattttattttggatttagatatgatttataggtattataaagtatattttttttgtagtagtttattaattttagattggtttgaattgtagttgagtaataatggtagttaaaatatatttaattaggttattattgtttaataagatagttttatataaaagttagaaattttttagttattagttaaagtaatatattagaatgttttgtttattatgatatggtaaaatgaattagatgtagatatagaggatatttatttattatgtagattaaatgttatataaaatatattatagatataattttaagagatagattattaaatattatgtattttttaatttttagagatgtgttggttgaatgtgtggttttggaatatatttgtatgtatatagatatttatatattgttttttgtgagtaatgaaaatattttaatttttatttaatatatttattatgataatttttgaattttagtatgtttataaattttttggaaaatttgattaaaatgaaaatattaagattattttttaagagttgtttagaaattgattttaataattatgtgttaagtgttgttaatgtaggtggtttttggattatagtttgggaaatattgatttattgttatgaaaaatatgttaattattaaatatgtaaaatattggttttttaaataatttaaagtaaagatagatattaagtattttttaaaaaaattaagtaataaatgataagggatttaaatttgtatggaatagaaatttttgttttgtgttttgttattagttatttgtattagagtaatttatgtaatttttttaagttagtttatttttagaaatggttgttgaggagaaaaaaattttaaggttttgatagatatggatgttaattaagtgttgataggatggtatgtattttatagaataattgattgtttatatttttgtataattggatttataattaaattaattgtttatttatttttgaaatgatgtaatgtaagtagaggaatgtaaaaatagtgaaattttatttgtgatatttatagtatatatttttattgggataatttaagtttatggtgttatataggattataattgttatagttatatgtattttttggaattttaggaaattattatttttaggtggtagtaaaaataggaaggtttatatagatttttgttttatattttgggagtgtgtgtgtgtatggttaggtgttttgtaaagtttgagaaaatgtagaaaagttttgttgattttaaattattttgtttgtggaattgataaggtattaattttatatagttattttgtttagaattataaaatttgatatgttaatggaaaatggagatagtaataatgaataaattaagtgatattattttttgtttattagtaatgttgagaattattgatttaattaatgaataaaagaggtattgttttagtaagtaagatttagaatttataaatgtatttatgagattttatttaattttttttttattagtatattaataagaattagtttattatttaagggtaaagttatattttaggtttggtaaataattgttgtttaaaatattaaatgaatattaaaggaaagataaaatatggtagataggttttagtaggagttgtaaaggatgaggggatgtgaaattgataattgttttgttgttgatgatttatatgaagaatttgtgtagaagagattgaagggagttaggtaattaatgggagtattgaaggtgatatagtaattttagatatataaatgtagtaggaagtaataagtatatttgtttaaaattttataagttattaatttgtatatttttgtatttgattttgattaaattttttatatttttagagttgtattgagttaatagggattgtgtagattgtttaaaaatgtatagttagtaatatagttagggtttgaatttttttattttagatatatttaaattttttatgttttagtagttttttaaaaagatatttaaaatttgtttttgatttagattataaaaaggattttttatatttaaaaattagtatatttttaataatgttaagttagtgttttttaaaatgtggtttagggtttatttaatattatttggggtgtatttgttaattagatagatttttgagtaaattgtaagataataaggatttttatggaaatagtttaagtatttgattttaattaagttttttaagtaatttgtaggtatattaaagtttaagaattattgtagtaagtgtgttaagtgaaggttggaatgtttgatattttggggatgttatattttatgagatgttttagaatgtgttgtattgttttttttttatgtatatggtatatatatttaagtgataggttgtttgaggggttaaggttgttgttatttgaagattaatgtagttttatttgtttattgaataatatattttattttgataatggaaggatattgtttgtaattatttgtagaaaagggggtattttttttgtgtgtgtattgtattttttggtttagaatagtatggtttttagaaatttttatgaaatgtatttgattattgtaataagttgtttaaatattgttaatgattttatagaaaatggttagatttttgtttatagagtgtaaagaaattagtgtgaggttgatttaaaatatattattagttagttaaagggggttttattatttatatttaaattgtatttaataatttaaaaattaattggagagagataatatttatatgaaagtgtttaattgattttgtattttattgtatagtatttttttttaaaggggtagtaattttaaaatttaaaattagttttatttttagaaaattttatgtatttgttttatgtattttatttttatgtatatatgttgtaaagttttatatttatatatatatatttatatatatgtattatttaaattttataataatatttttagtaggaatttggatttttattttaaagattgatattttagaagatgaagggatttgagtagtagaggaagaattttagattgagtttgagaggaaattgttttttagttttgaattgtagagtaggagatattggtgtttttttgtttggaataatatgtgtttaatttgaataagtttttgataattttttggaaatagaattttgtagtgaatgttgtttaatattaaattttaggttaaatatttttttaaaaaatgaatttttatgaggttgaaatagaggtataatttatggataaaggtatatttttttgtatttgatgtgttaaaaaattttttttgtaaaagtgatatgattatttgttgatatatatgaatatttttttaatatttttgagatgttttttgttaatgtaaatgattgtttaattattagtgtgatgaaaagttagttttatttgttatgatggaatatatttttattatatagtagtattaaattttttgtaaataatagttgttaatatattgttgaagtattttataataatttatttggattatttagtattagaataaaatatgataagagttagatggaggtttgtttagtagaaaaatgtatatttagatataggatagattttttaaatgagaaaattttagtgttgtttaaaggaaagagggagtaggaagaagaatgataagtagaggaagagagaaggagaaagaaagatgaagatgtgttatattgttttgttttattatattgagaagtgttgttgttttaaaatatgtgtaagagatttagtaaaggatgttggagaatagaaggtgaatttttttggaaattaatagagtgttagtttatgttagggatttattagttatggagatttatagagttgtatgaggttgtgagatgtagtagtagtagtagtagtatttggtataaggtttggttgggtgtataagaggttatagggttttgaaggttgatatgtttagggagttggttagtatagtatggttttaggaataggaatgtatttttagtttttgtttttggtttttttgttattttagttgttgagaagaaataagtttgtttttgtgattggtatatgtttgttagagttgtttttttttttttttttgtttttgttattttattttttgtaatatttttaggtttatggaggttagggggttagttgtgaattattaagtggtgtggttttaagagagaagtagtaggggtagttttttttatattagtaggatgggtttagtttgttgttttttttattgtgttgttgaaggatgtgattagagagttataaatgatgggataattggtgatataatagaatagattattagtagaaaaataaatgtgtgaataatatatgaaagatatttttatatttgaatggtaagaaatttatattataaaataaattatatgttgttgggggatgttttattgttttaatgaaagataaaatattttgaagtgaaggaaaagatagtatggaataatatagagaggtttaaaataatgaaaataattttttattttgattagagtgtatatatttagaattggaaaatagatttttagtaatgtttaataaattatatattttaaaatgtttttaaatattgatatttaaaatatttttttttggagtatatttataaattgtaggaatttttaataaggattaaagttttagtaatagatatttttttttttttttttttttttgtttttttttttttttttgagatggagttttgttttgttgtttaggttggagtgtagtggtgtgattttggtttattgtaagttttgttttttgggtttatgttatttttttgttttagttttttgagtagttgggattataggtgtttgttattatgtatagttaattttttgtatttttagtagagatggggttttattgtgttagttaggatggttttaattttttgattttgtgatttgtttattttggttttttaaagtgttggattataggtgtgagttattttgtttagttttttttttttttttttttttttttttttttttttttttttttttttttttttttttttttttttttttttttttttttttttttttttttttttttattttttttttttttttttttttttttttttttttttttagagttttattttgttatttaggttggagtatagtggtatgatttttatttattataatttttagtttttgggtttaagtaatttttttgttttagttttttaagtagttgggattataggtgtatgttattatgtttagttaattttttgtatttttattagtgatagggttttattatgttggttaggttggttttgaatttttgattttaggtgatttatttattttggttttttaaattgttgggattataggtgtgagttattggatttagattttatttttattttaggaaattaaagtttattttggataggattatagttatgtatatggtttatttattttattatttatttaataattttatattaagtgatttttgtgtgttaggtattagtgttataataatgaataagatatgtattttttgttttggttggtttatagtttaatggaataataaatggttattgaatatttttagttaatattttgtatgtataattttatgtaaattttgtaattgtgttatgaattagatattttttttatattaaaaggtgaagataattaggtttagaggttgagtaatttgtttaaagttgtaagttaaagaatggttgagttaaaatttggtaagatatggttaattttttttgtatatatttatgtattttggtatatgtttttatatattgtggttattattgagaaggaattgttaaattatattttagttttagaaaagttgtttgtattttatttttaatttattgagatattttgttgtatgtggatataattaatttttttttaggtttattttatttttttttagattatttatatagtttatgggtaaatagattaaaatattattgatgtattttattaaaatgaaaaataagaagtaaatttttatagaaattgtttttaattttttatttttatttatttgtttttttttttttttggttagtgttgtttttttgttttttaatagtaatattgtagtagtattttttgtttttaaatgtgaatatttgtgggaaatatttagaatttttaaattataatagtttattattatataaattaagattttattttgttatttaggttggagtatagttaggattatataaattaggatttgtgtaataataataaaattaaaaataaaaataataatatgttatttaagttaatttttataaagttaattgtttgattggtattaaagttttggtatttttatgtgtttgttttttttaattttttttttattaaaatataatttgttttattttgtatgtgtaatttaatgagaaaaattagaaattattaggataaaaaaagtgattaaatttatatttttgtgataaagtttagataggtataattagtgtgtatatattttaaaaatttttatttaagtttatatgtagataatgatgttatgtataattaaaataaaaagttaaaaatttttttatagattatgtaattgatttttttgttttttaaaagaattgttggttgggtgtaatggtttatgtttgtaattttagtattttgggaggttgaggtgggtggattatgaggttaggagattgagattattttaatatggtgaaattttgtttttattaaaaatataaaaaattagttgggtgtggtggtgggtgtttgtagttttagttatttgggaggttgaggtaggagaatggtgtgaatttaggaggtggagtttgtagtgagttgagattgtattattgtattttagattgggtgatagagagagattatgttttaaaagaaaaaaaaattgttttttattttttatttttattaaattgtttatttttttttttgtttaattttgtttaggaaaataaattaataaaaatttaaaattttaggtttatatatattaaaaaggaaaaatatgtttattttggtttatatattattatggtttaggtaaaaattttgtttagtttttgttaaatgttaggatttttgtaaattagggagtatatgtgtttttaaaatttattaaaaaataaatagatttttatatttttttttgatataatagtatggtgtaagtaattagtaggattttaatgttgttgttttaaatatgtttgattatatttatatgttgaatattataatatgtgttttttttttaaaattgttttttatgttttttttttgttttgttttttttgagatggagttttgtttttgttgtttaggttggagtgtagtggtgtgaagattttggtttattgtaatttttattttttaggtttaagtgatttttttgttttagttttttgagtagttgggatataggtatgtgttattaagttaggttagttttatatttttagtagagatgggggttttattatgttggttaggttggttttgaatttttgattttaggtgatttatgagttttagttttttaaagggttgggattataggtgtgagttattgtgtttagtttatgttttattttaatttatgtttttatttaattttatgttatgagattttagttatgttattatatatttttttaaaataatgatttaatgtttttttaagatgaaatttttattgtgttattattgatgagtgttttaatgttttaggttatattatttttaaggtgatttagtaagtagtggttgaggtaggaagttattaaatgatttaaatttaagaatgtaatatttttgtataaggttttgtttattgtaggaaggtttatttttattgtgttgtgtttattatggttttagtgaaaatgattaatatttttttatgtttaatagtatataggtttatataattatgttattgtattggtttgtttatatatttgtgtattttttttttgtgaattttttaagagtaagtaaattgtgttttttttttttgagtttttatagttatatgtttagttatagtggtggattttattatggagatgatgaaatttaagtagtagggttttttatttgtatgaggttattttagggttttgggtgaaattttagtagtgtaattatatggttgtatatgattgtaaaatttttaaaagtaagatattttaattagattgttatatggttttgtatttttgtttatattagtaattttattttttttttgttttgaaagaaggttttttaaatggataattttggttttataaaattttgattgttttttgttgatatgtaaggaatatttatttgttttttttttgaataagtgaaagaagtaaaagggatgaggaggaatgaatattttattaattaatatattgtaatatttaaaattagtatgtttggtaaaaattttttttaagttattaatagaaaatgttaatattattatttttgtgtaatgtttgtgagtttataagtttttatataaatgtaattttaattgaatttttgaattaggttttttgttaaatgtaatttttaattaaagtgaatgatattaaaatgtttataattgtgttatttgtagaaaagatttattatatttaatggttatagaggaaaagaaatttaaatatatgattgagtgatatttatgattgtattgtgttaatattaggatgttagttgaagttttttgatattgattttagtttttgtattatatggtgtttataaatatatttaaataaatgaaaatttattttataaatgaaaagtataaagttatataggttaataatgttttttttaaatgatgaatatttttaattttttttttttttttttttttttttttttttttttttttttttttttttttttttttttttaattttttttttttttttttttttttttttgatgtaggtgtttaaaattatttaattgttatagagttaaatttttttttggaaaattgaattgaatttttattgaatataagatgaaaatgtggttgttggttagttattttgtgataatatttattattatttgtttagtaggtaagaaatattttttgtatattttatatatattatgttaatataattgatatgtgtgtttattaaatgtattgtatgaagtaaaaatttttatttttttgatatttgggttagataagtagataaatatgtattaagggtgattttattttttttttaattttaattaagattttataaaatattgttaattttgggtaatagtgtgttggtgaatgtttaaaatttagatttttggggagatttttggagtgtagtatttgtttattattggggagtaaattattttattatggttagttttaatttgatattatttaatgtggaattggaaagatgtgtaattgtttattagtttgtagtatttttattattttgatataagtaattataatggtaaagagaatataaaatatagtaaataaaagagagaaaataatgggttttaagtatttattttttttgtttttagtataatttatttatttgtaaattaatataatttttaatattggttatgtttaataattgatttataaaatttttgaaaattaataattattttttaagagttataagtagatgtaatatattattgaattttatataatttttttgttaatttgattaatataatttaaaaaatggattaaagtaatttatagtgtgtgtagggatataagattaataaaataattttgagagtatatttattttaggataaagaaatattatatttttgttttttaaaggtaagtgtgaagtatttagatttattttttataatgagaagtatattatatttttatttgaaaaattgatataattatttaattagtatttattgagttaggttatttagtatttattgagttaggttattattatgaaagtattagaaaaattgaattttaataattaatttttttaatatttttatgataatgatttaatttagtagatatttgttgagtgattgttttgtttaagatataaatggtttttatttttttgtatataaatttttattgattattttaatgattaatttgatgggtattattattaagaatataaaaaaatattattttattttggggaataatttttattatgtttattttaaaatttagaaaagattattttattagtatttaaggattttaatgatattgataaatatatattttataattagggtaattatgtatatatatttatatatatagatgtaattatatgtataatatatttatatatatataatgtaaatataataaagaaaaaatttggtaaagttattgtgaagttttatttttgtgaataaaataaaataaaaattattttattattattgaaaatttatatgaattttattgattgtaaattttggtgttgtaattattaatgtaaagataagaaataagtatttgtatagatgtgaagatattttaatttttatagtaaagggttattatttttattttattgtttagtattttagttatttaagtaatgtttgaaattataatttaaataattgttttaggattaaaattgtttttttttttatttttagagtttatatggtatagaagatatggttatggaggtaagttgattaaagagtagattttgtaaatattttttttttattgaattatattttatttttgttttaaattattaattttttaaattttaaggtaaatggttaatgttagattattatgaaattttgtaaggtggtttttttgagattataagtaaattgtttgttgaatgagtggatatattataaataaatattttattagaggattgtagtaaatggaaaatatttaatttggttggtttttttttttgtatgttttgtaataatgttatgtgattaaatttggaagtaatattttaaaatttgtaagttttgaatttatttttgaaagttttttgttttgttgtaagggagataattaaagttagtgaaattggaattttaagatttagtttaattaaaagtttataggtattgtaaaatttattgtttaataatttttttagtttagagtttattttaattattaaatagatattgtagaaataaagttagtatggtatattggaaaaaatatagagtttagagtaagattagtttgaatttgtatttttagtttagtatttattagatgattttattattttgtataaattatataatttttatgagttttaattttttaatatgtaaaaattatagaattgttgtgaggattaaaaaatgaattgtaatgataatttttagtataatgattggtaagtaggtgtttaatgagtgtagtaatattagtaatttataaaagttattgtatgatggtaggagaatgaaaaattatgaagaattattgaataattagtgttagaatttgtatgttaaattaaggttatttattgtattagtttgtttttatgttgttgataaagatatattttagattgggaagaaaaagaagtttaattggatatatagttttatttggttggggaggttttagaattatggtaggaggtgaaaggtattttttaatttatttatttatttatttttgagatggagttttgttttgttatttaggttggagtgtagtggtgtgattttggtttattgtaagttttatttttgggatttatgttatttttttgttttagttttttgagtagttgggattataggtatttgtaattatgtttggttaattttttgtatttttagtagagatggggttttattatattagttaggatggttttaattttttgattttgtgatttgtttgttttagttttttaaagagttaggattataggtgtgagttattgtgtttggttgtaaaaggtattttttatatggttgtagtaaaagaaaaatggggaagaagtaatagtggaaatttttgataaatttattaggttttgtgagatttatttattaagtattttttaaaaatagtttatggttgttttttttaattttttgatttatattttttttttaatttgttgtaattagtgttttttatgagtatttaataaaaattgttttatttatgtttttaatgttatatattgtaagtttagtggttaatttttaggttttttatttaattggttggtagtagtgttgtagttttaggtattatatagagatataataatgttttgtaggtaaatagagtatgtttgtttttttttttgtatttatttatttttaaaaataaggagattttttttagaaattttatattatatgtttagagttgggttatatatttattaataagtttattgttagtaagagtaatggtattattttttgttaatttttatgtttgagttatgtgagggataggttgatttttgaattaagttgagttttgttatgaaagtaaagggtagaagaggagttgattagttaattaataatgtttgtgaattatttaggtgaattgaaattgagaatttttttataaatgaaaaagttatatttaatatgttatttagtatatataatagtttttaatgattattttatagtaatattagtagttagtgtttaaatatatgtattaaaataaaaatattttaaatttgaaaaataaagtatataaaagattataataaaattattaaaattaattttatttaatgtttttaagaatatttttttttttaatttttttttagattttgtgaaagtaatattgtattttattgagataagagagtaaatatgaataagttgtatataatttgtaatgtttagatatttaattaataattaaattatttgatagtaaatattttagatgtttttttttatttgtagtttgtatttattttatttttagaaagaaaaaaaaaaatttgtagttattgtaggattaatttatatttaggttaatttaaaatgaaaataagtattttttatttttttgtaatttattgagaaaaagtattttaaaaatgaaataaaatagtagtataatatatattttgtaagaattgggatatgaaataatatataatttatattttgtatatttagagttatgatatgattgtataatatttaaagttaatatttaaaaaaaaaaattatttttattgtttagttgtagggaggataggtagaatattttatatatttttatagtatttgtattaagattttttgtatatttttttaattagatttatattagttagtaagaattatttttagtatatatttttatttttaaatatgattgatattttatagtagttagtgatttgtttttattttgatttatggttttatatagttttattaattaaaatagattagagttagattgaaataggttaagttttggaagtaggtttattagtttagttatgttatatattaggatgtagtaagatgtgaggtaggtgttagaagatgtttagttaggtatgtaaaatagaatttagatgttttagaggtgggttataggataaggaagtagtttttttagagagatgtgataggttttttttgggtaggtaaagttaagtaaggagaatttagtttatttaatttttatattaatttgattatattttttattttaataattgtatttttgtaagtttttgaggttaattttttattttgtatgtttagttataaaaaagtattgtaatgttatttattatttatgattttaaaaaattggggtattagagtgtttaaaggttaagtttattttttgttattagtaggaaatggttggtagtggagataggaagttgtaatatgtggaagaaggatgttttgtgataatttaaatattattttatttagagagttttaagagagtttatattattttttatttaataattattgtaatattgtaaatgtaaaaatttttattttagttttttgaaattttgatgttattatttttttttaatagattttttttaggattttttttataatatgtttatgtaaaattgtgtttattaattaatagattgaggtgatatataatagattgggaagtggagtttgttttaaaaagtatataaaatgaatataaatatttttgaagtataaattataattttatttttaatttttggaagtaaaatagaatagtaatattatagtggatattttttatatagtggtaggtgaagtaattttatttgagattatataagtgattaattatattaatggtgaaagtgagaatgaaagaatagtagtttttgttttttatttatattagtaaatatgattgtaaatatttttatattatttatttttattttagtttttttgattatatttaagaaatgtatttatgtttgtaatagatttatgataattatattatttggtaggaaataaatgtatttgtattaaaagtagattaaaatagtgatatgaaatgttaaagttttaattagtttgagaggttatttataattttgtgttttttttaagaagaatttatttagtaaaaaaaaggaatgtattaaaaaataattttagtttttaaaaatataatttttatttgtggtttgttttttatgttttttaattttataatatttttaaagtattaaaatttgttatttaagtgtttttatggttgtagaaaaaaattaatagatgatagtattttttgtaggttgagaatataatgtttatattattggattttttgttgagttttgtattgaaatattttttaaaatttttttttttgtatttgagtattttagttgagttagtgtggttggaaattaaggtatagtttgtgagggagatatgaggattatatttaagaggtttatgttgaatttggtaatgtaatatagatgtttgttttgagtaatgttttttttaagggtttaaatatgtttttaaaataaaatatatatagtaatttttaaattgttaaataaaatatattatgtgatttaggtttgaaaagtttagaaagtaagaagaatatagttatgaaataaaatttttaatagaaaaatgaatgtgatgtgaagtgtgttttattttgttttttgttttaggaaagagtaaagggaaatattttaattgtaatatttttttaatgtgaaaaataattttagtatttttttggagatttgttttttattttaatttttgaaagtttgtattgtttgtttttataaaggttaaatataagtgggagtattgggaaatatatatatataatttgtgaaaagtattgtaattgagaagaaaaagtagtataaggtattaatgttatttagtttggtttataaaatttattttaaaattgtatattttttttgagggtttgtttattttttatatataggaataattttatatatatatttagtataattttataggtatggttttattattattagtatgtgatattttataatttttaatgaaaattttttttgttagtatttttttttttttttaaaaatatatattattaagataaaaaagttatttaaaatatatttttagttttttgaaagttgattaatttttattttaaaagtataatatattttaaatgaaaggatatattattaaaagaaatatttaagattatttattttattaaaatatgaaaatttattaatttttatatagaaatatgtttatgtgaatttgtttttattgtatttgaaggtgttaagtagtatttttagtaattaaagtaattttgaatgattataatttattttattttaaagagataaaaaagttttttttaaggaagtaaatgaaattataaattaaatttagaattttggatgatgattttttatataatgatatttttagaagttattttagaagtagatattagataggttagggttgtttgtttttatattggaagtataattgtgtaattggtttttattaatgtaagtttgtatttttttgagatgagtttatattttaggaagttatatttaattattattatattttttattattaaatgagattgatatttagtttttaaaaaatttttttaatgtgttgtttgtagaatgtaagttagagaaggtttaaaggaaaatttttaattttgaagatttgagatttttttaatgatgttttttattgagtagattttttgattttaagaaaatttaatttaattttttttttttttttgatagattatgtttttggtgttgtgtttaaaaatttattgaagtatttaaagttagattaaggatagttaatatttatagtgtattaaattgttgtttttaatatgattatttgaaatttttatgttattattgttgtaagaagtggaaatttaagatttaatttagtgtagattagtggttttatgtttaaagtgtatgtatatttgtaatataaatttatttttttttaaatttttttatatgtatagttttttttattggtaataatatttatattattattaggtttgttgtataaatattgaagtatttagaagatttttatgaattttatatttttttaagtaatatttatttttagttttttaaatatttatgaatttagatttaaaataaattgttttaaaataatttatattaaagttattatttattaaggattatagtgggaatagaaattattttatttttaagaagagaatttagatatattgatttttttatttgtttttttaagtatttttatatgtattgagaagaaataataagatttttaaaatggtaggtgaattaaattgttttagttagaaattttgtgtaattgggagagatttaaggaatagtttatgaaattgtttaattgagaagaaaaatagtgtatgatttttattagagataagtataaggttattttttttagaaattagaaaatttagattttttataaaaaatgaaagtttttagtaattaggatttaggatttattttttattttttttttgttgtgttgttataatttgaagagttagaaaatattaggtatttttagtaaaagtattagaagtgaagtagaaaatattatatttatttatggtttttatagttttaagaaggatatggaattagagataatttataatataatttttaaaattattagtagagagtatttttgtgattattttatatttgtaattttaataataattgtggtaggtatatggagtttttaggatatatgtttatgttttttttttttttgaatgtatgagttttgtaaaataaattgtttgtttaagataataattagaaaagtttatggtaggagttaagttttagttttttttatttttttgattttgatttagttattttttatttgaaataggatggtggttatggaatatgtttgaggtttataaattattgaataaaagttttagtaaattttaattaagaatgaggtagttttttttgaaatattttgggttaatttttttattaaataaattaattttttatattagtggtgggggtgggggggggggtagaattaatttgaggattttagtaattatttatatgtataataaaaatgtattgagtgttttaaataatatagtgttaatagtattagagttaaaggagtgaaaatttggtttttggtttttagaagttttatgattagttgaatagtttatatatataagaaatataaataaaattttgaagagattggtaaatttatgagagtgtttttaaaattagtatttatttattgttgattataagttaggtatattgttattttttatgaattgttttaaaataattttgataataatttttttaggtagattttattatttttattttataaagagtgatattgagttttggagagattaaataatttgtttaaaggtatattgataatgttattgaaataagatttaaatgatataatgaaattatttgtttaaaaggaagtttgaatagtatttttatttttaagtttagtgttagagaagataaaatatttgtgtgttattgtttttattttttttttaaaaaataattggaggagtgaattattgtttagattgggtagagatattttagtgatttgtaagaatatttgttttttttagttatatagatgattattaatttatttgaggtatatggttttgtattgtgttttttaaatgttgttgtagtggtggtatgtgaatgatttttttttttttattttgttatgaagtgttatttttttttgttagggagaatagattatgaggaataattgttttttaatatggttgtttgtgataaattttaaattagttgtttagatttaatatttgtgtaatttattgattgattgttttagatggtgttgagtgttaatgttagttatatgtttagaaaaaaattaataaaaattggtttagaaaagagattgatttttttaatattaagaagtttttttttgtatttagatttttgtttaaaaattattaggttttttttgttttttagataatttaggagaatgatgtatatagatgaaagatgtagttatttgtttttaagtatttgtaatttagtagaatagaaagttgtattaagaattatagtaagtgtattaagtattataatttttatggggagttataggaatttaaaagaggattaataaaagttaggagagatgagaggttttggttttttgttggaattaattatggttaggttattaaaggattatgtaaattttgataggataagaaaagtagaatgatgattttaggaaaattgaaagtatatgtggaggtttaggggtatgaaagtatagtttgtttggggaagtggaaagtagttaagtttggtaatatatggtatatttggaaaaatgataggagatgtatagaaaataattttaaatgaagaatttgatgtttggtttagtattatggaggtaaatatttttgttttgaattaaaatggagattttgtttttgattttttttaagtaatttttttttaatgtttttaaattttttttgatttataaagtagtataatgtaaaataattttatattttttgtagtttttgaggaagataaaggatttggattaatttttgaagagtagttaattaatattatttatttagaggaattattggaaggaaaagttttatttaattgtagggtatgagttagtttttttttggtttataagtaatgtattttgtttttttttttagagtggagtgttagagtaatgattatagattagtatttatgaatttgtatagatgtaatatagtgttttttgtaaattttatggatattaataaaaatattggtatataaattattaaaaaagttgtttaatgtttaaatagtagatttttttaaatatatgtaaataatttttttattattttttgtatagataatgttattggtatttgatattatttatttataaattgtataatggaaattatgtttttaggtttatgaatggttatataaaattatgtataatttaaatatatagatttgaggataaaatgtttttgttatgtattggtttgtataatttatatttatagatatggataaatttttatattaagtatatttaaagattttgtataaataattgtagaaagtattatattttttaatagttttatatttatattttatttaatatagtaaattttttaaatgtttttatttataggaaaatttatataaatatattttttattatttttttgggttatatatgtatgttatttaaaataattttataaaaagtaataatgagtttttttgttttagatgggttataaaagtatattaatagttttttatttgatgtaaagaatgagatgtaaaaattaattaaatgttagtggatttaaattttatttgtgtaatggttttatgaagataaaataagtgattgatggagaaattgggggttttagtgtgttaatgttatttgatttaattgaaagttgttatttaataaagttaattttaatattttttttttgatataaaagtaattttttattattataaaaagtttttataaaagagaatatttttttttatttatttgattttaatagtatttagtttttttttgtttttggttataattataaaattatttttaagataaaattgtgaatttagatataaaattattattttattgaaattatttttattgttttaattttatatatggaaatatgatataagtaggtattttataaattataaataatatatttgtttttaaaatatttgatgggttagatttatttttatttttaagttatatataatgagagtttatttgttattgatatggaatagtagaattaataggatttgtagaggagatttaatttaagaaaattttataggagaggaagttgaattttgaataagtaaatttgtttgtttaagaattagtaaattatagatttaagattgaaatatagtttttatgatttttaatgaggtatgtaatttttttattatttatttatttggatagattgatagaattttaaaaatttttttagtgatatttatgttgtgatattttgttgttaatagttatataagggattttagtaaattagtttttaggttagaatagaggtaattaaaagaaagggttgtttttagataatattttagaaatatggaaaaggttatgtttttttttgttgtttttatgtttttattttataggtataataaaaagtaaagttttgttttgttagtaagttattaattgttttttttaggttgtatttagtattgaaatttttattttgagtttggtttggttatttatatattaatagatagaattggagaagatagatagatgtttaattttgttatgaagatagtttgtatttgataggaaaaaaaaaagtggggggaaagaatagaaaaaaaattagtttatgatggaaatagtttgatggaaaagaatatttaaagtttttaaaatgtatataattttaggataaattatattaattttggtaattatttaattttttatttatatagtagttatatatttgtagtatgttttgggataatgtgttatttatagtaatattttgagaggtataatagggtattttatttttgatttataagttttgaggtttttattattttgtttttatttttaaagaaataagtattataataaaaaagtattaaaagggattgtagtaatagtttatgtttttgaaattagattagtgaatttttttaaagatagaaaaaggtaatttttatatgatgttataagtataattagatttatgtggaggaaggtaagataataaataaatatttggaattaatataatgagggagaaattataaaaattggagttgtttaataaagaaatttattgttttgataagagttaagtaatttaatattagatggtttaggtagggataatattgttattatttgggggaagaggaaggttttatttattggattgtaatttagtaagttttaaaaatgtaaaattatagttttttatatttgtttttaaattattttttatattgtgaaaattgtaattaataatgttttagtaattttgatttgataatagatattttaaagttattaggatttttgggtatgattattattttaattagaagtggttaggaaatgagtgatgtggttatgagttattattatttgagtgatttgattatagttttaggtttatgatttttttgaggatatggaattttaaaggataaattttgataaagaatgattataaaattatatagttggtttttttagttgagaattattttttatatgtattttttttattattatattagaaagttagatttttgtttttagtttatttataatattatttttattagttaatgttttgattatttgtagtatgttttatattgttatgatattatgtggttggggagaaaaagaattgttttttttttttattttattaaaagtaattttagagtaatgagaaaagatataagtgattattaattttaggttgaggaaaatttagatttatttgtatatttgtggtttggaataaatttttaaaaatttaattgatttttattatttttaaattgtgtgattgatttttagtggttagaatatgttatttattgagtagaatttattgttaattagtttgttttattgaaaaattattttgaaatttagagttagatattgatattttgtattttatttatggtagaataatgtttttaatattttatatagtatatttgtatatgtatgaatttaattggtgtatagatggttattaattatattttaagaaattaatttatggagaaaaatttaataaaatatttgttatttgagatattttataaaaaaaagataaaatatgttatgtattttgatgtttttttgtttgtatttgagttaaattataaattatggttttagagatttagaattatagagtataaagaaatattatttgaattatatttttaattgtttgattttatatggagttgtatttaaattattttagaattgtgttagttttgtagagtttttaggttttatgatttgtgatatgatttttgtgttttttttttatagatggagaatgaataatggggatgttgattttataagtgattgatatagtatggtaggaggaaattttgttattaataattttgataaatagaaagatgttggaatatattattgtttagtatttaataattatgggatggttagaagtattgaagtaattttgagttttggatgtaagtaaattgtaatttttaaaaaagggtaagtgtgtttaggtgagtttagtaagaagaataattaggaaaggatagtgagaggaaggtattatagatgaggtggattttataagatgagtggattttaattgtgtaatggagataataaagtattataaggtatattatgaatgtatttgaaatagtgaaagatgatgttgttaaataaaggaaggttagtgtttgaggattttgaatgattttttaaaagttagtattaggttgggtgtggtggtttatatttgtaattttagtattttgggaggttgaggttggtggattatgaggttaggagattgagattattttggttaatatggtgaaattttgtttttatttaaaatataaaaattagttgggtgttgtggtgtatgtttgtaattttagttatttgggaggttgaggtaggagaattgatggaatttgggaggtggaggttgtagtaagttgagattgtgttattgtattttagtttgatgatagagtaagattttgttttaaaaaaaaaaaaaaaaaaaagatattaatggaagtaataagttatgtattattaaaggggtattattatttttaagggggtgaaaattgttttttgggggaagaaaatgttatatattgtaatataatgtttgtgattttttaaagattaatttaatatgataatattgtattttttaatatttaatttttaatagtaggaataaatttaattatattttagttaatttattttaaatttaaattatatgaaatattttttttaattagggttaataatgaaaaattgtgttaagttaaaaattagaggttgttttgaaagaaaattttatattgggagatgagttggattaggtgatttttagtatgtgatttgttagtatttaaattttttgtaaaatgaattataggatgaaaataatgttttaagaagttttttatggtagggtttattaggagggaatgagaaaggtttaggaagagaagtaagattaaattagtgtggtgagagtggaaatgtaaataatatatattaattataaggaaagaattaataggttgtattgtataaaaggaaagaagattgtatattttttttttaagttatgtttagttagagggtagaaatattttgtttttattaataatgggatgggagtaagaaaaattaattttaaggatggtaggaagtatttaaatggttgttttatatgtagaggttattttgatattgagttatttaagttgaaatgttaagtaagttattgaggatagggatggtatttaagtaagatattaggtttagagaagtagatttgaaaagttttttgtaaaaaagtaatatttagtatagatgaatttttagaggtatatattttatattgagaaaagtaataatttaatgttataatttgggtgttgattataggttaggaataggaagagaggtagaaaaaaatagaatgagtattagtaaaataaatgaagaattggaagaatattaaggaattaagtgaaatgtaagttttaaatatatagaaaagagtaaagaaaattagaattgaaataaatttagaatttgagaaggagtaagagattggttatttttatgttttttaatgagggttttgttttttatttttatttttttttgatatttaagtttttttttaggaagagaaatattttttaaatgagtttatttttttaagttatttttttttatttattttttttggtaggtttttggtttgtttgattttattgtatttttagatattttgattgagattttttttaagtttgaaataaaagtttttaggatatttgtgatttttagggttgttagaatttttatgtaggttgtttttaatatttatagattttgagtttataatagaattttttaatagtttatataaaattttagtaatgtaagaatgaggagttgattttattaggttttattaaattattgagaagtgttgtattttatgaatgagttatttgttgaaaggtaaaattgatgaatgtttttttttttattgattagagagtgaatgttttttttttttttttttgtaattagattttgatttttttttatttgaggaatgttttgaggttagagtaaaagaagggaaaggaatggtgtttttttgtgattttttatattattttttaggtaaatttaatttttttttgattattagtatttatgaaataaaatggataagtttttatttttttagtaataatgttatattattaataattatggtttattattaattaaatgagattgaatatttgtatattttgtaatgtgttattaattgttgtggatatttttttttttggtttagttatttggttttagttttaaggatttttaattattttagtttataaatatatatatatatatatagtattatgttattattaaagtttttattttatagggaaattttgttagattttttagaaaatatttttgaaatagaatagtattaagaaaggatgtataattaattatttttttaataagttagtatttatgaaatattgtgaattgtatgtaattaaattttagaagggataaagatataataaattattaatttttttaggaatattaattagtaagaataattatttattttataaatggggttaaattaagtgttatttgttatgaaatttaattttgaatttatgttttttgtaattttatatggttaagataaaagttattaaagtgttaattaaaagatgaattttttatatatttttattaatttttatttatttattaaatatttttttgaaataatatataaatatttgtttttataatttaaaaattatgtttttatttttttagttttaatattatgttttaaatttgattttaaatatttttatagagaatgaaatgtaataggtttttaaattttatataggattttgtgtgggatatattaatttgatgtgtgtgtatgtatatatatatatatatatattttatataaaattatgttatatattttatatgaaattgtgtgtgtgtgtgtgtgtatatatatatatgtatatatatgtatatatgtatatatatatgtatatatatatatatgtgtatatatatatatatatatatatatatatagagagagagagttgtggttgtttatatattaaatatttgtgattttttttataataggagaaagatgattgtttgataaatataggaggtatatataaaatttaaaattttttaatatttttttaatgagaaaaattttttttttaaggaattattgaaattatatatatatatatatatatatatatatgtatgtgtgtgtgtgtatatatatatatatatatatatgtatatatatatattttaaaaatttattatttttatagtgttttttataaagtaatgattaaaattatttagtgattatatttgattatatttaatattggatggattttattgtattatttattgatttagaaaattttttatgagtatttgttatatagtaggtataatgtatgttatagaaatgttttagtggagtaaaataggaaaagttattagtttttagaggttttttatggggagagttagatattaataagataaatggttaaaagatatgttatgttagatattgttaaataaggatagatagatagatagatagatagatagatagatagatagatagatagatataatgtagggaagtggggagagtaagtattgaggggaatgattgaatttaggaggagtattattagaaggaaagttggaataaatatttgaaggaagtaaaggagttaataatatgagtatttgagagaagagtatgttaggaagatgttgaggttagattatggaagattaaggaagttagggtggttgttatagagtgaataaggtagagggtagtaagaaatgaaataagagaggtataagagttgtattatggaggattttatgatttataataattattaatattttggtttttattttgaatgtgatttatattggtgggttttgagtagaggagatatatgatatgatttaagttatagaaaggtgattttggttattgttttaagaaaggatttggggaggataaaggtggaaataagagatttgtttggaggtattgtaatagtttaggtagtatatgatgggttagagtggtggtagtggaggtgggaagataaatttaagtatattttagataaaatagaatatattaaattttatatagaaatttaggtatattttggttaaattttagatatattttgaaggaaaagttaataggatttgtttgttgattttatgtggtatataagataaatataagagttgagggtggtataaaagtttttgttgtgagattttaaaagaatgaagttgttattattttagttgaaggaatagatgtggatatgttaaatgtgaagtatttgttaagtttttaaatggaaattaaggtggtagttttatatgtgtgtagatgttgggggtgatggaatattaatttatgatttattatttaataagttgtttttaaaattatgggattgtaatgtgtttatttagatttttggggtaaaagtaagaagtgttatatatttattgataaaagtaatattttttaagtatgtgttggtatttattgaaaaaataattttatggttatttattgtttaatttagtttataatttgaggaaaatagatagtttttgtaaagatgattgattttattatttgtgtggggttaggaaagatataaagaagatggtttgttgagtttttgaaagaattagattagggtttagtttttgattgataaagttatattttatttgtaagttggagagttagtgtggttattgttttggtgttggtatagtttattttggtgatggtgggtggggaaagaggtgagaatattagttttgttttttgtttgttgtatgattttaggtaagttattttattttattaggttttggattttttatttaaaaatggtaagagttatttttatttttgttgtaatgattgttgatagattttaataaattgtaattattgttttgtttaagtgaatggttttaaaaataagtaagatttgttaaataaatttagattaattatattgtaagttttataaatttaaaggttatatttattttgtttagtagtatttggaaggtatttagattttgtaaaataagtaaattagagaatttatattgggtatttagttagttagattagttgttttatagtttaagatttatgtttatataatattatgataataattttttggatttagtatttattttttataaggattaagtattattattttttttatttttttttatatattttttatgagtggggtataggaaaatgttttatattttagagaaattgagtaatagagtgattaattggtttgataaaaaagttatattgagaattaaaatttaggtttttgtatttatataattattgaggatttagattattttaaatgtattttgtgggtagtattttttatatattttatagttataaaagttttttttttgtaaggaaatataaaattttttgatatttttggttttggtggtggggtagggggagtggggatttaatttttaatagaaatttttataaaatttggatttatattttaattgagaataggaaatattaatttagaattagaaaagattaaagtttttttttaaatgtattatatatattagtttggatgaaagattatttaatatttttttttgaatgtgatatttttttatttattttaggagtttttatttaagaaatttaagtagttttttaaatatttttttatattaattattttgtgattttaaattagtaagaagaaaataaatgaaaagaatttaattatttatagatataagtgtttagaaatatatgttaattgtaattttgagttagaggttaattatggtagtttaattttttgtttttttttatttgtattttgtttttttaataataaatatatgttgttgtttttataatttgaaaaaattaatgttgaaaattaaaagaatataattatatttattgtttgttttgatgttgtattttgttggagaaaattatatagttaagttaaatataatgtttaggttattatttttaattatgtgaagtttatataatgtgtattttttttagttttttatagttattgtgtttttatattttttttgaaagttttgttagttatgttgagtttttgaaagtaaaatagttatttgttatgattatttatttttaaaagaagtttgagtgttgtgattttttggttttttattattttatatttaaaattttatttagtttgatttagagagatttttatttatattttttttagtagaaattgtttttatgtgattaagatgttttgaagggaattattattttttgatttaaaggtatgtattgtttattgtttttttgtgtatttgttgaatgatttttggggagttatttattaaaatagagaggaaagaaggaatagaaaattataggaaatgtagtaaattaaggaggaaatttagttttttatttaattagttagtgtgtttagttaaaggaattttatgtgggtaagagttattatatgatatattttttaatatttaattaaattagtattatatttttttttgtttttgtggtttttttttttaatgtgattataataggttatgtaagtttatttttaattttataaaataggtgtatatatatatatatataaaaaaaaaaagataaagtaataatatggtaagtaattttaattatatttataaaatgtagtttggtagattaattatggtttttgagttattagatatggatttaaaattttatttttttttaatagttatgatattttaagtaagttatgtaatttttttgagttttatttagtttattaatgaaatgaaagtaagaatataatagtttattaaataatagaaatagataaatagatgtaattgtttagtgtaatgtttatatttatgtgaaatatggtatatgtttaaaagtgtgtattgtttgttttggtttttttttaatatttgttttataatagtttttattagattaagtgatagtttgttattagtttttattaaattatgtaataattttgggagaagtatttaatatttagaaggtaatatttttttttagatgattttagttattgttggtttttaaatgaattttttgtatttattataatggataaatggtgatttgtgttttagataaatggtaatttttatattgtaaatgttgaggtttttgataaaggtaattatttttgttttgtttttagtttttttattataaagagtgtgtttagtaaatttattttatttattttaatatttgaatgtaagtattttatttgttatattttgtttttgtaaggttatttatatatggtatatttattgtaatgaaaagaaatatttagtgaagattagttgattttttaggaaggataatataaaaggggatgtatgttgaaggggttaaaggtttggttttaagttttttgtgttgagaagatttagttaataaaattgttgtaagaaggttgagtttggatgagttgtttttagtttggaaaatatataggggattgatattttagtttagttttagtgtattggttatagtggaaattattgatatttattttttgttttgtggttatttttattttttagtaagtttatgaagaaattaaaggattggtagattaaaataaataatagtaattgtagaattttttaagttattttgattattttggtatttttaaggaattatttatatgatataaataagtaaataaatggttttttttaatttatataattagtatgaggtgttattttggtagtattatggtagatgatattgataatttgattggtttttttttaggttttaattgaattattttttttttaaaaagtattgttgtttaagagaattaaattatagtatatttgtttattttatattatttttatttaagtttttttgttatattaatattagtaaatttaagtttatgagagtatattagttttagattaatagatttaggtttggtttttgtttttatttttaagtatagtgtgatgatgggaaaaatgttataatattattgaggttttatttttatttttttttgtaaggtaatatttatataattggtatttaaaaaatattgttgattttttggtttatttttttttttttagttttaagagataattttattttttattttatagattgaaaaggagttattatgtaaaaatttttttgattttttttttatttttttttagaaatatatttgtaatttagtatttttatttatttttttattttttgtttttatagtagaaatatttttttttttgtttaagttaagttttttagttgttttggtttatattttatttgttttaattagaaattttattataatatttattttttttttttttgaatttttagattttgttttattttattatttttgtatatttttttgtatttaatgtaattttgaattattatgaatttttatttgttaaatttaaaggatattttgaagtttttattttgtttgaattttgatattgttttttttgttttttatgaatttttttttttttatttaattttttgaattttttattttttttttgtttttttgataaattttatagaatattttttataaaatattttttttttttatatttttttttaatttttttttaggtatttttatttatttatatatttttaatagtatatttttgtaagagattttaagtttatatttttgaaattttttttgtgtttagatgttaattttttttatattttggatttgttttttagaaagtttttatagatgttaagtttaaagtgttataaatatatgtgttatttttttttaaaattttttttttatttagtttatttagtaatatagttttatttttaataatttaaggtagtattatttattattaaattttaatttttattgatttttaggatagttaattttgtggtttttaattagtaggtaagtatttggggagttttgggaataatgtaggatttagagatattgatttagtaggtttggaatatgatttaggaatttataagttgaattagtattttaggtgattttgatgattgagtttttaatttatattttgagaaatattgatttaaggagttgttttgttgattttgtttttaaaatataatttatatttattgttttttttttgtttttattgtaattatgttttagtgttggtttttatttgttttgtttgaagtattgaaatagtttttttggatttttgagattgttttttatattttttttttttatgttttattttttaaaaatgttagtaaggttttttatttaaattaaagataagatttatattattttttttattaagttttaatggtagttatttgatatgatttggttgtgtttttatttaaattttattttgaattgtaataatttttatttgttaagggtggggttaggtggagataattgaattatggggggttgttttttttatattgtttttgtggtagtgaataagttttatgagatttgatggttgtataaaggggagtttttttgtatatgttgttttttgtttattgttatgtaagatttttttttgtttttttttaattttttattatgattatgaggtttatttagttatgtagaattgtgagttaattaaattttttttttttataaattatttagttttagatatgtttttattagtattatgagaatagattaatatattatttattgagaaaatttattttaaaatattatttttttagtttttttagattgtgggtttaagtttatatattttagtattatttgagtttttagattttttaaaattttttgtatatttttggagttttgttgtaatatggtgtttgtttaagttaaattggtttaatttaaatgttatatttgttttagagtgttatagtttttatttatttttaattattgtttttattagttatttttttaaagtatttattttgatttggtttatatattattatttatttatttgtttttttagtattttatagtgtgtggtatatatttaatttgtgattttaaataatgttttttatttttttaagtttgattttttttgtaagtttgaaggattaatatattttttaggattgatgtgttaaataaatgaaataaagtgtttagtttgaagagtgttgtgttgtttgagtaaatgttttttttttttttttttttttttttttttttttaatttgtttttttttgtttttatttttgtgggtatttttttttttttttttagttttttgttttgtgttttttttttttatttttttttttttttttttttttttttttttttattttttttttttatttttttgagttttatgtagtattgattataatgtttgatatatatttgttgtttattaaagataggattttttttagtaaattgagttataatggttatgtagttgttagaatgagttaatattattgaaaatattgagaagttatattatatttatattgtgtataaataaataagtttatttattatgatatgatttgtatttgtatagagaaaagtttttatgttggagtagttttaattttgtagaattattatgtttaagaataattaatattgtgtttaataattagtggatatttgtgttttttttaatattaggaataataaaattatattttgttgatattgtagtttagtttaaggatgtatatgtattgatgggttaaaatgtgattttagaatgttttgtatttggaaagtaagtatattgatatttttattaatatatatagaaatagtattattttaggaaataaataattgtttagttataaatataaagtaattgttttttaagtgtgtgaaattttaatttttgtattttttatttaaagttttgttttggatatttgatggtggaaggttttagaattaatgttaagtattgttgagattagtatttttggggttgtttttaagatttttaatatttagttagaagatgaaggtatttatgaatgtgaggttgagaatattagaggaaaggataaatattaagtaagaatttatgtttaaggtagatatattattttaattttgtataaattttattagtattttatttagagttatttttatatatgaaaaattattatataatgattaatggttttaaaaatagtgatgtatgttatattatggagaaagataaaatattttttatatgtttaatgaagttataattatgagttatagaagttatgaatttattattagttgaattataggtaatagtaatagattgatagaagtgttattggtaatttttagaatatatatttaatgtagtttgtttatttattttattattgtttttttttagtatttttttatttatagaagaagttatgtgttatgatttagtttaagttagtggtttgtaaatttaagtatgtattaaaattatatggagggtttgttaaaatagattgttgggttaaatttttagaattttttatttagaggtttgttaggggtttatgaatttgtatttttaataaatttttaaaggatgttgataatattggttttggagttatattttgagaattattggtttaagaaatttttttttttttttttgataaaattattatggtataaatttttgatttttatatattaaaataaatttatatttgggaagatagatttttttttaggttatattggaaattttttagattgaaataatttttataatgttttataatatgaattttgtaggttataagtgaataaatattgagggtttttataatattatttgtttttaattttggttattgttttattttatttttttttgttttttttaaaaaggaataaaaaatttgatagatttatgtattttttttaaaagtgttgtttttatttttagtttttttttttttttaattgtattttaatatgatttgtatttttgtttttttatagaaatttttttttttatgattatagatttttatattgttaaagttaatgattaatttttagttgtatttttttttgatttaatagtagtggttgttatagttggttttttttttttttatgatttattttttgtattttatgtttgtaatttattttgttattaatttttttgtataattttttattttttattgttttttaattttatatttttttaatattggtgtgattagggttttatttgtgaattttatttttattttagttattttatttatgattttatttgtgattatggttttagatatattttgtattttgaatgttttaatttaaatatttattttgaattttagatttgtatgtttaatgttatagtaatattaatgtaatatatattaagtttgtatgaaatggttttttaaaaggaagaaaatattaggtaaggttttttaaatttttgaaataaatttattattttttattaggtttttaaagtttatagatttgtttttatttaatatattaagaaaattatattttaggtttttaatagagtaaaattttgaattgtttaatatttaaagttttagaagaattaaggtgatagagtatatatttatagaaggtaatttaagagaaatattatttattttttattaatgtagtatattaagtattatttttaggtttgattatattattagaaggttatataattaagttatatatagattgtgttaagttaatttaattatttattatatgatgtaatagaaaatgtttgtgttgtttttgtgaggttaagataggaagggtgttgatatttttgtattatgtattgttaagattgtatataaaataaaattttttttttttataatgaatatatttattaatagtttaaaaaatatttttttatgttataaatataatgatgagtgaaaatatgtattaaataagattatatatgttttaagatatataggtgtatatatgtttatatgtataatgtatatattataatgtataatgttgatggtatttggtgagataaaaatgttttttagtttttaaatttttagtattttattatttgttaaatgttttttataagatgtatatattgtttttgttataaaattaatataagtttttagttttaaagaaaattaaatattattttttatttaggattttttttttttattttttttttgtattaatttatttatttgtatttatttggattagataattgaaataattaaaaagattgttaaattgtttatttgtttgttttttaaaaatattttttttttggaaaatttttagtatttttttatttttatggatgtttttttagttattaagtagattagattaaagaatgagattgagattaattttattaatgtatggattttattaattatggttattgtatatagtttttaatatggaaagagtatatttaggtgtttaagttatttttttagtgttaaagtgagatgttattgtggttattagttgaaagttttattaaaatgaagataatgtatatttgagggagtgggaaaaatatttgagtttttatttaaaatgttaagagatggtattatattgaattgagatgtaattttttaaaattttaattattattttgatagatttgaaaggtttatgttatgagtagaaaaaaattagttattttagtaataattataatttagttttttaataaaatatgatttataaatggaaaaataatggttgagttatagttattttttgttgtaataatataggatttgtgtaggttaagtttatgtaaagataaggtttattattgagtttaggatgtatatattatttgatgtattttgtagaattaggttaattaaatgtaatatttatattttggagattatgatggattttgagttttttatttaatatttataatgttttttattttttagtattttttgagtgggtagaatatattaatgatatagaggtggatataggtagtgatttttattggttttgtgtggttataggaaagtttatttttataatttgatggttgaaaaatggatatgtggtatgtatgtttaagtgttttgttgtttttgagtttttgtttaagtagtgttttagggtagttttgggataaatttagtaggagagataatatagaaagggtatttgggttttgaaatataaaagttttttaaaaaagataaaaattgaatataaagtatttttttttagtttaaataattttttgtaattttattttattttttttttttttttttttttattttttttttttgttttatttttttattttttttttatttatttatttttaatatttgatattgtttttttttttttgttattatttttttgtattttatagagatagaggtaagagtgaagttttaagttttatttttggttttggggataagtagtagtagtgggatttttttttatttttttattgtaattttttagttggtttaagaggggaaaaggtggatttttagttttgtaggatgaatagaataagagtttttgggtatggtaagtgggttttttttttttatgttatgaaaattttatttagtttattttaggtaatagtgggggtagatgaatataatgtatttaaatgaaaagataattaaatttagatttaagtgaaagtatttttattaaagtttattgagaatatgttttaattttattttttttagtattataaaggggaattaagattgtatgatgtgatttttgaaaatgttggaatgtattagtgtatagttgaaaatatatatggagttatttatgtaaatgttgagttgaagattttgggttagtattatttttaatttttgttaaatattgttaaagtaatatgttatattatataaaatgtttattgagtttatataaaatatttagtattgtgttaggtgtataatatatgttggttgtttattgatttatttattgttaattattataatttagattaatgaaataatggaatagaatgaatttttgttataataaaagttttttttagagtattagtagtagtggttatatttaggagtatattagaagtgtagaattttaggtttattttagatttattgaatggatattttaaaaagatatttagatgattttaatataaagataattttgagaatgattagattagaggatgaagagttaaaatttagatgaagatatgtttaggtttagaaaagtttttagaaagtatatagttatggatgattgtaatgtgttgaaatatatggatgaaatttgtttggagtttgttaagggaagaggagagtgagtagtggattaaatgtgtggatgttgaggaaagtttgagtatgatattaatgaagtaattttttttaagtttttgtattttgttttaataattattgttttgtatttggaggtaatgatgaattataaatgattatgtttttttaattagttgattagatttattatttttatagttgtttatagatagattttgaaagtaggattttaattattttggtattttgtagggtgtttgtatatagatgatgtttagtaattgtataaagaaggagagattgtattgtttaatgaaaagtatatgttttggaaatagaaggatttagatttaaatgtgatttttatttattattatttgtggtatttttgttaaattaaataattttaatagattttaatttttttatttataaattgggaatagtttatttaatatgtggtttagaggattgattaggattatatgttagtgtgtataatgttggttaattttttttagttttttattttattttttttgtggaattgagttaaagtaatagaatttagagttaattttaaggtaaatgtgtataaaatatttgattgaaattgaagttatttatttattgagatagggttttatggtgttgtttagtttggagtgtagtgaggtgattatgttttattgtagttttgattttttaggtttaggtgattttttattttagttttttggatagttgggattataggtatgtattaatatgtttagttaatttttttgtattttaggtagagatggagttttgttgtgttatttagtttgtttttaaatttttgggtaagttatttgtttattttagtttttgaaattgttgggattataggtgtgagttatttatgtttggattttaattaaagtttttaataattaatttagttattattaagaattgtatatttgaattgggtgaattttataagttaaagttattaaataaaagttataaagtattaggtatagaatgtttattggtgatagttgattatatttattgagattaattttttttattaattattaaggagaataaaagattttataatatagaagtaatgtttaggttttataaatagaaagagaaagataataatttgttttttttttagtgttggttttaatttttgaaatgaattttatgaagaaaaagattttggttgttaaaggtggaagggtgataattgaatgtaaatttaaagttgtattgaaattaaagtttttatggagtaaagggatagagtggtttgttaatagtagtaggttagtgttgaaattagaaatttaattgtaaaatttgtttgaaaaagtttattttatagaagatttgtttatatgttaataatgaaaatgttttttgttttgaatttttttttttatagaagattttgtagttttaagatggatagaaatatttatttttgttagtatttattataatgaaggtttaattaataggattttataatgtataaggaatttagaaaattgaagtttagaggtgtttttttgttgttttgttgttataaattgtttaatgttatatagttaataaataatgggaaataaagtaggatttttttaatatatttttttttagtataggtatttggtatttatatttatttatatttaattgaattttgtgtagttagtttattaaatatttttgtagaaaaataaaaaggtgattttaaagtgtaaataatttttttttattttaaaatgaataagatgttattattattttttttataaatggattatttattaatgttttggtggtttggggataaaatgaaaaagtagtgtataatttatatagattatttgtataaaagttatattgaatagtttatatgtattttagaagaagtaatattgagtgtaaaaattatgatgaggagaaagttaggatgggaaatgggagggatgggatgtgtgggttggtttgagggtgtatgtgagggtgtatgtgagggtgtatgtgaatgtgagggtagtatgtataaaggttttatggtgaggagtttagaatgtgtaagaaattgtagaaattgaaattagtgtgatttgtttttagaggaaaatggaggagatttttaagagatgagatatagtaagttatattataaatgataaagttttttatgttaaggggtttgggttttatttaagagtaatataaatttgtttaaagttttaaataagggaggataaggattatttttgttatttgaaagattgttattatttagatgtagaaaatatattattttttttatagtaatttaataaagtaatatgggaattattatttatattttgatgtgtttaaagtttggtaaagttaaagtgattttttgtaaaaatatatttatgttatttaaattagaatttgaagttgtaagatattgatataaattgagaatatgttagtatagtttttttattaggatgagtataggtatggttgtttatggaatggggtaagagggtagggatattaggggtttttttgaatatattgatttttaaagttaatatgtttgattttagggttgttaagattttaataaaatgatattataagaagggttaaaggaaaagtttatttgtttaatttgttgttgaaatattaatggttagataatgagtaatgtagagattatgattaaagggtagttatatgtgtaggtgtttattttttttatagtttagagtagggtattttttaatggataaattattagtttttttttgtgataataaaatttttttttgattttgatgaagatttatgttatggatttttttaattaaggattttttagaattatgttttatggatttgttttttttaaatattaatatgtgtttaaaaaaagaagagaaagatttagtttttgaaattttataagtttgattgtgttttgatatttttaaagtttttgaaattaaattgtattatttttttgattaaagagtttataaatttaatttttatttagtattttaatttattattattttagtgtaaatattatttaatagtagatatagtatttatatgtaaatatatttgaattgtaaaataagatgtataaaaagttaaatataaaaattttggtgtttattttgaaaaagaatatataaggattaattaaatattggtttttaagtataaatataattttatttttttgaatataattataaataatatttttatgtaattaagttatttttgtatttggttagtgtttaaagagtggtttatatgatatttggaagaagttatgtattttgataaatagtaattaggtttttattttatgattttatttttggtttaaatgatatattttttgtagtagaatttttttgtaattagtagaattaagttagttgttaatttaaatttaatggattgttattagttttaaggttatttttatttaaattatttataggaagggatttttattagttttttttattttagaggttattttggagtaattttggtattaataagtgattaattggttaaagattagattgtttttagtttgtttgatagttgatttatattatagtatttggaaataaggataagattttgagagtttagtttatattattttaagaataaagagaattattataaaaaaattaggttttttaaatatttttattaaaaagtaattttaattttaaaggtaaagtatttgaaagtataaatgagatgaatgatatatggaattatgtatattttttaaagatggtaaaagattaattgaaaattaatataagtaagttaaaaatattagtatgatttaagaaagaattattattgttttttttattgttattttattataatttttgttgtgttttttgaaaaataattaaatgaaagggatgtgggaatttggttgaggatttatattagagggtagtgagaaaaagtgtgatttattaatattggtattgtgttaatatgtgttttttaagaagttgaagttaggaagattagttatgtaagaaattaattaatggtaatgtatgggagggaaaatagagaggaagttggtggaggtttggaaaagtattttattgagatataggtttgattttagatgaaggatagagggaaggaaggaaaaaagattgtgttgaaatgatttggattgtattgtatttttaagagtatggttatgttattggaaagttttttatttaaaaatgtatattagaggagtttgttgttttttaggagtaggtttggtttaaaattttttttatggttagttattggttaagaatagtttgtggaatgtgtggttttgaataaatatagtgatggatttttgagtatggtgtttgggatagagaataaattatattttttagagttggagagtggtatatttttagagtttttatgattttaaataattatttttattattatattattttgatattttattttttttttaataataaaaagtattttgaaatgagttttaagttaggattggattgtttaagaaaggaaaggaaattttggattataatgttagtggaaattttgttatttttttatatgaagatttttattagtaaggtagatagttttgttttttttattagattttgtttttaaaatggatatatgtttgtatgttttgtgtaaatttttaaagataatttagttttgaaaattatttatttaaagaaagtaaaaaatttaatgataggtaatttaatatttaatttaagtgtgagtttttatataataaaatttagtgagtttttagtgtttattttttgaggaagaggttgataggtagggaaatatgtgtagtatgaaagatttagtttttgtttaaagaagaattttttaaatattaatttgttttagaagttgttattaaggaggttttaaaatattttttaaagtttttaaaaataaaatatatttatatttttttgtagttatggaaatggtaatttgtttttattttttagtttgaattgaagttttgaggttatatttttgggagattggggtttattttttttaggtttatgattgattttagtttgttttatagtggaaggttagttagaagattatggtaatagtttaagaaaaagatgaaagtggatttttaaaataaaatgttaatgatgagaaaaaatattataattaaaggttagaatttgttattttataaaaatgtttgtggttgtatgatttatatagaatgtaataattgaaaaatattagtgtttgtaatttaagatataataatgtattttattaaattaggtttgtgaattatatatatttttattttattagaatatttatttgggaagatggtagtttggaaattaataatattataaggaatgatggaggtatttatatatgttttgtagaaaataatagagggaaagttaatagtattggaatttttgttattataggtaagttaatgtttgagggtgtttaatttttaatgtattaaaaaatatgatttagtattaagtatttaaatagttaatgtatttgtaagttttttttttaaaagaattttaggtaagttttttgtttgatgatattgtttttggaatttggaagtgaaaatattttattattttgtataaataaaaatatattggttattattttaatatattagataatattgtgttttatatttttttgaattgtgttttatatttaaaaatatatagattttatgtgaattatattggttttaattaatgttgatattatagttggagaaaatgttattatgtagtgtgttgtgttttttgattttgttttggattttatatttgtttggttttttaatggttatgtgattgattttaataaagagaatatttattattagaggaattttatggtatgtgttttaagttttattttattaatattttagtgatttttatgtgtttgtattgaaagttttattattataattatattttatattatttttgttttttatgagattaaaaagtaggtaaaaaagttttttgtggttttttttatattaattgttgtattgttaaatttttttaaaatggttagttttgaggattttggtataaatattaattaattaatattaattgggttttaggtatgattttttttttaattttaatataattgatgtgtattatattagtatatatgtgtttttggttttagtgtttttttttttattttaaatgaagagtatagaatttaatttttgttataatgatgattttaaagtatttatgttatgttttaagagtaagaaagagataaaattatatatgttggagaatttggagaattagtttatgtgatttgaagagggttaaatggttatattttaagaattgaaaggtgttatattttataagttttatagttaaatatagtgatatagagagttaaggtgtagaaagaaataaaatagagggaaaagattgagaagtaatgtaggtaaaataatttgtgtaagaatattgttggtgttttggtaggttgtttaggttatagtgtatttaaaaagtaaattaattattggttttattagttttttttttagaaaagtaaatatttgtaagattaaggatatatttagaatataggtataattaggaaaatttttattttagaagttagttattaatataaaaaagaagtataaatgaatttagtaggatatttaggattgtttaagttttataaaatttgaagattgatatgtatatattattatattatgtttttatattgtttagttatgtttttagttttagaagagttgtaatttaattgatttagttataattgtatatttttagtaaatatattaatatttttttagtttttgaattaaaattatattttaaagaataataattgagaattggtagagaattgtaaattttgtattttgatattatatattatgtaatatattttttttatagatttgaaattattttgtatatgtttaaaattagttaaattggtattaaaatttttaatattttatttaaagtgtattttattttgtaagaaaagtaaatataatttgggttttatttattttaaaggaaaaaagtaagttaaatagggattttatttttttaaaaagtaggtttttgaatttgaaagaattatttttggtgttataaattgaataattttaaaagtaaagtttagaagttttataattatagtttataaagtagtaattaatagttgtaatgaagtttatgtaaataaatttgtagataaaaattgttttaaattgaaattttatatttagagtttatttatattttttaaaatattaattatattgtgttggtatatgtaaataatgattgtaaaaagaaaatggaaaaaaaaaggaatttaaagagaaagaaaaatagattttagttttttttaaaaaaaaaaataggaaaataaagaaataattggaatattaattaggaaataaataataaattagattataaaaatgtaaaagattttgtggttatttagtgtatattttttttttttagatgatagttgtagagatttatatagttatttttttagttaatttagagtagagttttgattgtaggtttattattttaggttttagtttattttattaaataatgatttgatagtgggagtaaatttatttaattgattagataagtattttaattgaattagaatattaaatgtatatgtttagtatgttatagatggatagatgtatttaattattttgatttttaaaaagtttggataagaattattttaaaataaataattaaattgaattttattttttaaattaatataagattaatgaagttatttttggtatttttttttttttttaaggtaaattataaagttaaattttattggttaatatgttatgtaaaatttaagtaaaaatgttataaatatttgatttattttttggaagatagttttaatagttattaattgtttttaggattgttaatagattatttttagaattagtggttttttttatgaaaattttagtgaatatatatatgttttttaaataatgatttggtattttatgtagtttttttaatattttaataattgaatagtatttgtttattaagaatatgtattaagtatatgttataagtagatatagttgtaggtattaggttaaataaaatattgaaatagatatggatattagtttaaaataaattaatgatattttaagagtttaagatttagatgtaaatgttttttggtagttattatagttaataaaattaatataattaatatgttttaataatttttattgttaaaaattaatataggaagttttgattaataataaaaaggaatagggaaattaaattttaaattttttattttaagaatttaagtttttattttttaatttagttttaataataaattgaatttaataattaagtatgtattgattttagtttgttatttttgattttaattattaaggggtaattttgtataaggatttaaattttatagtttggtgtaatttgggatttttttttttttatgaaattaaataaatgtatttgtttttatttatgaataaattgtgagattataggtgatttttaaatgttttttttatattttttttaattaaagttatgtaattattaggaaaaatgtaattgtatatttttaaagatgtatattttttttaagagtttaatgggaatattaaaaaagtaaaaataatattgtttttgtatttagtaattttattttatgtaaaattttgggattaatttattttttaatgtaatttttaattttaaggtagtaattgtatatttagtattgattatagaaaaatattaaggagttaaatatttaaaaattttttgagtattatattaatatgtaataattgttagatgttttattggaatttgaatttatgtatgggggatgttaaaaatataagtttgaagtagaaatttaataaatttgaggttttgatataataagatattaaagtagtttatttgttatttttttattttgttgatgttatatggtaaatgattataaatgttttaagtttaattataaagtggtttttgttttggttttttaatttaatagttatttaatgttttggagtaaatataaaaggtagagttattttatttatttatttaatgtataattttttttgttttagaaaagatttaagataatttattaaaaatatgaattttaaatattttattttattttttttttaaggtggtatttaatttgtagaattttttagtagtttttaatttttgatatttattttgggttatttttttttaattgtttaataatattttttgtttagagttattaagttagttaattatatgagttttttaaaatttttagttttggagattgttattattttatatatatatatatatatatatatatatatatatatatatatatatatatatatatatatatatatatgtattatttttattataaatatatgttaaatttgtaatattgtgggatattattgtttgttttatatgaatttataaatattatttgaattgtttagagattgtgttataaattaatttgggttttaggttttatttttttattttttatgtggtgattttgatttagggattaaaattttttaagttttagaatttttttttgtaaaatgtgattaattatttatttattttatttaggttattttattgggtttgaaaaattagttattttatgaaagagtgtatatagagatttggtatagtatttgagagtattggggatatgaataaagtatataagtggttattaatattttttataagagagtaattattttttattggaaattttagaagtttttgttagttagtttttttttttttttttttttttttttttttttttttgagttatagattttattttttataatttaatatttgtattgtttgttgtgttggatatttagattgagattaaaaaaaaaaaaaaatttgggtattttattgttgaaggtagtgaagaggtaataatagttaatatttattgtgggtttattgtttagatagaattgggttaaatgttttttatatattttttagttgatttttatagaaattttttgtggagtgtatattattgtgatttttttagtttttaaagtgaggaaagtgagtattagaaaagttgagtaattggttttatgtaattatataagttgttagaggttaatagaagatttgatattaggtggtttgattgttaattttgtaatttttattattttgatttattttttggttaatgtttatgtttgtgtttatttaaataatttttttataagtatttgatgttttataaggtaatattgtttaatttatattttattttttaatttggtttaatgaattttgtatgtttatttagattgtttaaattattttattttttttatattgttggttatttttgtaatatattgtaagttatgtttatatagttttaagtggtttaattatgaagtttttggtaatttttaatgattttttgtagataggtatgttaggtgtgtgtttgtaggtatgtgggtgtgtattttttttgagtgtataagtaatattatttaagagagaagaagatagattttttatttaaatgttattttttttttttaaagaaaaattttattaaatatattaaaaaaggtttttagattttataaatatgtatttaaaattagattatgttgtgattttgtatagaaattttgtttttgtaagataagaaaaaggagaggaaaaatgataaaatagaagttaatttgtttttttttttgtttttttataatttaattttttatttttatttatattttatgtagaatgtttataattagaaagaaaggtttttttttttatatattttaagttttagggtatatgtgtatattgtgtaggttatatatgtatatatgtgttatgttggtgtgttgtatttattaatttgttatttagtattaggtatattttttgatgttatttttattttttttttttttattttataatagtttttagagtgtgatatttttttttttgtgtttatgtgattttattgtttaatattttattgtttttatttattattttggttgttgttgttgtttttgtgggttttttttttttttttttttttttttttttttttttttttttttttttgagatgtaggttagtttttgttgtttaggttggagtgtaatgatgtaattttggtttattgtaattttttttaggtttaagtaattttttggttttagttttttaagtagttgggattgtaggtgtttgttattatatttgattatttttttgtatttttagtagagatggggttttattattttggttaggttggttttgaatttttgattttaggtgatttatttgttttggttttttaaagtattggggttataggtatgagttattgtatttggtttttatttattgttgaataagaaggttaagattatttagaattatgtgggagaaaatgaggatggttgggtaataatttttggtaagaattagatttgagttgaaaaaaattagagtaggatattaggtagttatagggagattgtggaagttttgaagtattgtaattttggttttatgtggagatatttttggttattataattgtagaggtgttgagagggtgtgtgtgtgtgtgtgtgtgtgtgtgtgtgtgtgtgtgtgtgtgtattgtatttatttagttattaaatattttataatgtataagatagattttaaaaatttagtattatttggtttaaattattgatagaattaagtttgagaaatgtttttaagaaagatattaaaaaagagatttagtaatattgggattagttattgtaaggttttaagtatgatgtattggaaataaagagatgttatattgttttgagtatttgagagtattggggatatgaataaaaagaaattagattttttaaaatgtatatttaaaatagtttaagtagtagaggatgggttttatgtgttttttgaatttaagatttttaaattttgatgagtagtggaaaagagggagaaatatataaaaagtatataggtttttggtatagttttgtgatatataaaatatataaaagtatttggttaatgttaaattgttttattttttttattagtagttagttggaaaagagttaattagataattttattatattttattttgtatgaatatataatttttttgattttttttttattattttaataaatttttattgatatttaattgttatattttatttgttatttattagtgttaaatgaaggaaggtatttatgtttttgggtgtgtttttagttgggttagttttttttaagattattatattttttatgtatagattatgttagttgatgttattttttagtttaattttttatagtttttattaagtatttgttgataagaatgttaggtgaatggaattaagtatatatatatataagaatgttaggtgaatggaattaagtatatatatataatataatatataaaatgtttattttgattatttttttttataaagtggtttaagaagatttttagaattttaaagttaaggggaattaatttgaaaattatataaattaaatgatatatgagttgtattttaattttaaaatataggttttaaattaaaggtattgatgtttttgtttattatttaaaatgtttaggagaaattttaaagaaaatggttttttgagtttttatttaaaatggttagttgattaaaattggattttttagttgttatttttgttgtttattatatataaaaatagttaaatttagagatttttaatatgtttatttttaatttatatgtaaatatatttttagtaattattttagtaattttagaaattattttggataatttgttttatttatttttttgtatgtttaatgatattattttattttaataagttgttttgttattttatttatgtttttgatttaattttaatattgatgtattttttaaaataattttaataaaaattagataatattagagaattattgttaattatgttatgtgtgaaaatggttttgtatataaaaattggtttagggtggtggtgtatatttgtaattttagttatttgagaggttgaggtatgagaattatttgaatttaggaggtggaggttgtagtgagtttagattgtgttattgtattttagtttgggtgaaagagtgagattttgttttaaaatttaaaaaaaaaaaaaaaaaaaaaaaaaaagaagaaaaggaaaatggttttgtgattatgtaagaaaatgattttaattttttgagatttaagttaatgtttttagaaattgttgatgagttgatgagttgagtagtattgatattataatatttggaatttattttttaagtgtttagttttagatagaaagatagagatagtggatagagagaagtaaatatagagttagttagttagataattagataaggtaaatatggtaaaaagtttataattgttaatttagttggttggtttatagatggtgatagtattattttttttatttatgtttgaaaatttaaatagtaaaaaaataagtaaaataataatatattatatatgaagaagtattatatttatttattaaatattaaatttagttatttgatttattaagtattattttggaaatagtttgatttggtgaaattagggttatatattatttatggagttttttataagtagtttaatgtaaaattttaaggtttttatttttaaaatgggaatattaatagtaaatttttgggtagtgttatttttggaatttagaagtgaaaaggagatagttttagttttattattagggttatgaaattataaatataattatataaattgaataagaaaatgtatgtaaagtagttagtatattgttagatatttaaaaaatatttagtaaattagatttggtaatagtaggagtttaatagtagtattagtagtggtagtaataatagaagttatattagttattttaatagtaataggagtagttttagtagtattaatagtgatattagtaatattagtggttatagttatagtagttttgtgtttttttttgtaaaatatagttaaaaatagtatgtattttataggtttgttattaagagtaagttagtttgtatgtatatttataataatttttgatatttagttaattttaattaaatatttgttgttagtagagttggtggtggtagtaatgtttgtagttggatatgatatatttgttatagtatttttgttttttttattttaataagttaaaagtaaagaagaaatgttttattattttatggatatagtatatattagatatatttaataatttttatgtttgtgaaatatattttttaaaggatgtatttttttttaaatatttatatttttttttttattttgaatttgaatggaataaattatttaaatgataattatgagttttaagttttatttagattttttttgtattatatagaatttttttttgtttattaagattaatttaatttgttaatatagtgttattattgagatttatttatattgtagaaatgattttgtagttagtttatgggggaaggtgaaggaagggttgggtatttatatgttggaagttttttgatttaaatttgggaaatttttaagtggttaattatatatatattttggaatatttttgagttttgttattataatttttagtatgtgatttaattttttttatttgaagggaggaattttgtaattgagttaagttgtggtttttagtaaaaatatagtgagtatttgtatttaatttgtggttagaatgtgttgaggtttatgatttttatttgttttgtaagtgttttgttaattattgaggattttaattttttttgaggtatggaaagtgttagtagtatttataaaaattttaggagtgtttttatatatatataattatattgggaatgatattttatatttttttttttttttttttgagaagttttattgttatatgtttattaaatgtagaattagtgagaataaatattatagttgttttttattgttttatgtaagtgggtttattgataaaagagttaatttttaaattagtttaatattaaatttttagagtagtttaaaaattgtaaaagagtttatggtgaaaaattaataaatataaatttaatataatgtattttaggatataaaatagtttgtgttttttattatatgtgatagtataagaagaatgattatattatttttattagaataaaataagtgaatgtataaatagtattatgttttaaagagagtttagggaaaaaagatagtaattttattaagaaagaaagaagattagatatattatataaatatttttaaaagggtaattatgatattataatatgtttatttttatattattttttgtttttaattttttgttgtaaagtttaatgaagaaatattttaaattgttaaggtgatttttttgaaaatttaaatttaatgatatggtttattgaaatagtgggagtttagtaatagggttattttttaattagatattgaagtaattaaagtattgagtttatttaatgaataaatattaaaaaagtgttttttatttgtatgtagatattattttttttaaatataattattattttgtgttgtaatagtttgaaagattttatttaatatatttatattattgaatatttagtattaagtgtatttgtattaaggatgttaagaaatattaaaatagtttatttaataaatatgtaatgtttattttattttataataattattttatattttatttttttttattaaaaattatttagatatatatgttaattaatttttatgatagattaagaaaaatttatatttattttttttatatatgaattttattttttgtttattttaaaaaaaattttaatataagtaataaaataatattttttattttttttgttagatgaattttatttagtataagaagttaggttagttgtaaagttgggtatagttttttaaattatttttatttttgatattaattgtaagtttaaggggttgtaaaaattatttttagtttttatgttttgttagaaggtatttatagaatttttttaaagttgttatatatatgggtatagttttttataggagaaggatataaattaaaattagttaaaggaaaaagtatatagggtagagttaagaagtataaaatatagagtttttattattttttttttgtgtagttaaaatgtattattttgattgttttgatgtgtgatagtatgtttgaagtattgttaattagtaaagtttattaagtttttttgtttagagtttttggggggattttattaattagatatgattgatggatttattgtttatatggttaattttagtttttaggttgattgatattatatgaattgaagattttattttaagttaaaatgttttatttgtggtatgattaggtttttttttaagattttataggtgtagttaatttttgtttgaaattatatggttggattttttagtatgatttaatttttattttatgattagttttagtttgaagattatagaggtgtggttaatttttattttaaattatatgattggattattttgtatgatttaagattttttaagtaaagaaagatattatagagattattttttagaagttgagggtaatggtaagatttttttttgggtaaggttaaattttttattatatataggggtgggaaaagttagaagtttagtttttttgtatgttagtgatattgttttttttataaatttttatatttttttaataatttttttatttttttatgaaaatagtgtatagatatttgaaatatattatttttggtagtttattttatagatatggatagtaatagttttttttaagttagttattttattttataatattattattattttatttgaaaaaattatttgaaattattgaaagaatgtttatttaataaaaatattttagattattttaatgtatttatttaatatttgttgaatttttttgtatgttagatattatattaagtattttgtatgtaataataaataagatttggttttttttttaaggaattatagtttagtggaagaaattaatagtgatatgattatggtagaaaggaatagttataatgaaattgtatagagggtaataattaatttagttttataattttagatatgggaggggtatttaaaatgtgggttgaatatttatagttaagtaatggaagtgggaggtggggtaatttaggtaatgtaagtgatatatgtaaagttttgatgtgagaatatatagtaaagtatattttatttattgtggttggggtataggagttaggtgtaggggtaatttgtggaggttgaaggtgtgtgtattttatttttatataagaaaagttttattatttgtttagtaaatgttgttattgttatgggttatatgtatttgttaatataattttgaatgtagttgaaaagaagtgaatatatattattttaagagtagatattaaaatttttgataatttgataagtttatttaaataaggtatatttagtgtgattatttgtttggtattgtgttggatttgagaagatagtgtatatagttgtatatatatataatatagggatataatatgtttgttaaataaaatagatgtatttttttatattaaatttatagttggttagggagaataattttaattatataattataaaagtgtttaattgtatttatgatatgtaatatgatagaagttttatggtagtataataaaatatagaaagggtatttgtttagtttatagaaaatggaaagatttgttggagaaaatgattttaattggtattgggtagaggtgaaggtgataggggagggggtattgaggttatgaggggtatgaattataattttagaagataagataatgtgatgaattagagattgaagagaataagatatatttgtggttttaaaaagagaatgttttgtttggagagtagagtgtgagtgagatggtatattaggtgagttggagtattagagagagtttagagaatggaattaagttggttataataatgttatggtttttgttttaggaaagggaaattttaaaggttttagtttatttgtttttatggagataagtgagttgggtttagttgtatttttaaaaggttattttaggtaattaatagaggaaagaatagagtggaatagtggtggaagtagtgattaaataagatgtaggggtttaggtgagagatgtgggtagtttggataagaggtagtagtgatggaaagaatggataaatttaagaatttatgatgagtttatgagaaagttgaagaaagggaggggttaagaatgttttagaagtttttggaaagttagatgattagaaaaaaatgagtatttgaggaaggaaagttaaatgttattaagaagttaaataagatgagttgaagtagtgggatttagatgagaattgattgaagagtaagaaatgaagaaatggaaaaattaaaaatagaatagatattgttagaatttaagtaaaaattaaataattaaatagtttaatatgagaaaataagaattatttatttttaagagaaagaagagaaaagaagagagaagtaagagattggtagtaggagtggttgttaataagatggtagagtattgggagaggtgaaggttattgggaaatttttagtaaatttatggttaataggatttttaaaaatagaattatgtagtggatgatattttttaaggttgatttattttattttttttttttttttgatataattagttttagtttttttagttgtttagtaaattaattttattaggtaagattttatgttatttggttttttgataaaatagagaaagtgttgaatttttagtttggagttttttggtatgataaaaataaataaataaataaataaataaataaataatagattaagaggatagaaggaaaaaaatttttttattgtaggaatttgtagaaattttgggaattgttttaatttttgattaatttatattttaagggattggaagattttaattgatattaaattaagattggttaatattaaggattaaggtgtgtggttattgattagttttttatatggagatattaatattttgttttaattaattatattaatatgtttttttagttattatttttaattttattaatttagtaagggttgtaaatttaaatgttttttaagaattggagggaatatgatatatgaagaggttattggtagaatttatggtgaagtaaaatgtttattttatgtatagttatgatatattataggtatttagatatttattattgaaatagtaaattaatatttttggtttataggaaaattaaatgtttatttaaaaattgagttttttaagtttttattttaagaaaatattttggagataattaatatgaattttgatatgtttttgttattatataagttgagtgattttagttattttagttaaattatttggattttttaagtttaatttttattgttaattaaatggatataataagatttattttatagggtagttgttaaaaaagaattgaataaaagtgtgtgtatgtgtgtgtgtgtttgtatgtgtgtatgtatgtgtatatgtgtgtgtgtatatatgtgtgtgtgtgtgtgtgtgtgtgtgtgtatgtatgtatgtatgtatatatttgtatagattaggatttggtatagagtaggtattgaataattattagttatttttggaaattatattgaaatggtgttttattattataagtaaaatttttttaagatttaaaaatatgtgttgaatatttttggaggtaatagaatagagtattgaataaaataaatatttttgtttttgtagaatttataatttggtaatagagtatatgttagtggaattgtatatttttttaatttttgtaaatttttagtatttttgtaaaatgaattgtggtatatattaaaattagttaattagattagttttgtgaaattaaattaattatttttttaaattatatagtatttgtttgtatttattgatatttaaaatttattgatatttattagattttaatatttttttttaagagatattaatgaaatagttttattttttgagttttttttgatataattttttgattgtggaaataatagaatgttaaagatatgaaagttaaaaaatattttattaataaattatttattttattttttagttgagaaattgaagtttagagtaaggatatagagttagtatgtttaaaatatattttttaagtggtgtttattttgttaggggaaaaaattattttttggattttaaatgttatataattggtgaaaaatgtattgatttgaataattgttgtttttgttaatagttggattttaatggggaattattaatttgaaatgtgtagttgaaatatgttggaagatatatatgtattgtttagataattgtggataattttttagttttagttgattttgtagtgagaggtaagagttttaatattttaaaattataaaattaaaagtatttgatttgtataaatatgtataattttttggtaattttggtgtaaatttttatatatttagagttttaattttatgtttaagaatggattttaagtttttttttatgtttaagaatgatttatgttagataagtagtaaataatattgattttgtttgttttattaattatgtattttttagaaagttatattatatattttttattaaatgtttgtgttttgtagatttattaaaagtttttgttttttgttaatattttttagtgtgttgtgtatagtgttgtttttttttttatttttatggaaaagatatatattgatgttgtttattataattttaattgttatatatttattatttttgttttagagtgtaaagttaatttatatatgtattatgtttttatttgttgttggtttttttaaattagtgtttttgtttttatgaataatataattgagattgtgatggaatatatatttattaaaaatgtaatttttttgttattggttgttgttatagtagtgaggttggttgggaatatagtatattttgtttaaaataaagagttggttttttattgattgttttttagttttgtatttaagaagtattatgtgttgattttagtttgtttatttttaatattttattttatgtaattaattttaattatttaattaatttataaaaatatattttaatttttatgttagttgttttatttatagtattttttttatgttttttttttatgatttgttgattaaattttatttattttttaagttttaaagtatatattaagtttatgaattttttttttgatgtttttaatatgagttttgattttttgaatttttataatatatattgtttttttttatatgttttatagtagttggtatatagttatttatttttttaagttgtaaaatttatatatgttttttttttagtgaatggtagagtttttttgtattgttttgtagttttttttttttgttttagtgttagttaaaattattatttttttatattttatttattaaaaatatttattgaatattaattgtatattttgtttttattttttatattattagataaattggtaataaaatgatatttgtggtttgtttattttaattttttttttatatttgggttaatataattttatttaattttatgtagtttttgtatttttttttagagtaatgttaatatggggtttttaagtaatattgggtaaatgttgaaaatttttttattttatttgaatatattttttaatagagttttaagaagtttagttgaagtttttttatttgaatgaatttggaaatatattttataaattatttattgaataataataaataaaaatgagattataaaattttaagttaaataaaatttatttaggtttagtatttttatttattttgttatttgggatattgattgtttttaagaattattagggagagggattagagggattagtttattattttttttagttagattattagttgttaagttatttttagaagtagttaaagtgtatatttaattgaaattgtttgtatatgaaaataattagtattaatattgtaataggagttatgttatagtgtgtggatataaatgtttttatatgattatattgtagtaaatttatagtattattattatagaatattttgtaatatttagagtgaagaggaattttatagatgaaatgtaagggtagttatgatattagttatatatatttaggtaattaattattattattatatgtatttttatagagaattaataaaaagaagttatagttaatattatgtagaaataaaaatgtatatagtattttaagtttttgtattatagtaggatgttaataaaattatataggtatatgaaaatattgtttatttttgttaaagttagtagagttataattattttttaaattttatttttaataatagaaaaagtatttattttatattaaaagaaatttgtaattaaaatagttaaatatatttgattattgtagaatttgtgttaaaaatatgtatagatgttttaatatgttttatatatttaaattagaaggtagataattaaatagttgtttttattttttaataataatggtgagtaatgtataagatatgttttgttttaagtgatattattattggtttatttatttatttaattatatttttgtatttagtttaggaaattataatttggagtttatgaataggttttaagggatttatggattattagaaattgtatataaaattttatgtgtatgtatatttttttgggaaaatgatttgtaatttttataagatttttgtagttagtaatgttttataaggtattaaaaagttaatttattttttatttttttatttagattaagattttttaataaaataaattgaagagatgattatttattttatgtaaaagaataaaatattaatatattttatgtagttaaatttaatagtatatttagattgtgaattgtttttaaaagatttgatttgtatttaattttttaaaattatatgtttgtaaaaaatattaaatatgttatgtagtagatagtagaaatttataagaattttttatatttgagatggattaattttaatttatatttagatattggtaatttgaattgtagttgttgaaattagtggtgtaatgagaaggatagtaaatatagtagaggggaaagtaattttatttgaggattgttaaaaaattttttataataaaattatttttgtgtataaatgattatgttttattagagaagattgaaataaaagtataaatatttagatataattaagattgtggattttttttagtttatattatattgaaggaaatgaatatatagtaagaatagtgttgttgttttaattaatatgtgtgtgtgtgtgtgtgtgtatgtgtgtatgtatttgtaattgtgggtggaaaagggtgagtatatgtatatagtatgatgaaagtaatttttattagaaaagaagtgtgttttaatttattttttgtttttttattgtatattgagtttagaatgtaagtagttaagtagttaaatttgaatgtttttaaatataaaattaaaattaaatgtaggaaaaatatagttaatggaaaatgtagtattggatttgattttatggggttttttattgagagaaaatatttttgttgtgagttttttgtgttatgtatggtaggatttagaaatgaagaaagtagtggtaattgttgttaaagaaaaataatttgtagaaaatgtttttgataataagatatgaattattgtaattttgtaaaagtataaatgtgtatttatagaaagttatagtattttaatttatttattatataattgggtttaaagatgtttgaggaaaagaggttagtaaagttgtatgtattgtttaattttttagttttgtaaataattttaaattatgagattgtattgattatgtaatttttattttttttttttaaagttggtttttatatgagttatatttgttaattttggtaatatttttgttagtttttttatagtatagagattatttttgtaagagtaatatttttttaaatgttgttgtttaggaggtttaatatataaaattgaagatgaagataaataaataaatatttgtgttgttataattttggtaaaagtagattatttattttgaaataggatatttttaattagttttttaaggattttaataaatttagataaataaaatatgaatttatataaaaaatgaaaattgatggttaggtgtggtggtttataattgtaattttagtattttgggaggttaaggagtgtgtattgttttgagattagtttgagtaatatggtaaaaaatttgtttttattaaaaatataaaaataagttaggtatggtggtaagagattaaaatgttatgtttgatatgatgatatttaaataatttatagaagattttagtgaaagtttattttttttttatgaagaatatatattgattttaattttttaattttttaaataatattgttggtgaaaggagtaattttagaattatttttttaagataggggtttgtataatatatttgaaggaatttagaatttaaattattatagattatttaatatttaagaggttttaaatatgttgtgttatgtttaaaatgtttaaaatatttatattttaaaatgttaatattaatatttaaaatgttaatatttaaaggttttaaatatgttgttttatattgttttagttttaaaataagaattaggtattatattttagatgtttttaggtttttggtataaaagtttatattaagagtattgatataaattttttttgttgttgtaataaaatttttattttttaggttttataaaagtatattttgggttgttttgttaaagtaagtgtttgatgtttgtgaatagttttgtatgaatattttttagtaaataatatttttaaagttttttagttaaaagagtgttatttagaggtaagagttttgtaggatttatatagtaagatttattttggaaatttatgtgtagtttgttaaatttaaatttttatttatgagtgtatttttggataatatttaaaaatagattataaaattaggttttaaatgaaaaagaaattaggttttaatttgtatatgtattattattttttttggtatttttgatgtattataaatattttggtaatgtttttggttaaggaatatttttttgttatttgggtgaataaaatatgtttgttattgaaattgttaaaatagaaaatgtaattaagattatattttatatattatatatttgtttatattttatgtgttatattaaatgatgtttgtttatttaaatttgagtttaaaaataaataaaagaaaaagaaaatgattttgttatttaaatttttttttttggtttggtttttaattttaatatatgttgtatagaattttaaaatgttttggaaaaagagtagttgaaattaaagtaaatgatatgaaaattttgtaaattattttttttttaaaagaagtttgtgttgtttatattattatattagaagtttatttatttaattttatgtggatttgtatttaggtgaaaatattgtgtaagtgagtgtgtgtgtgtgtgtgtgtgtgtgtgtgtgtgtgtatgtagttttttattttatttttaaggaaaaaatatagttatagaatggagagagatattagttagaggttatttttattgatatattttgttaaggtttttattgtttagtttaatgatgtggttattagatttttttttaagaaggttatttagttgattattaaattatttttaaatttttggataagttaaagtaatatggttgaataaataaataagttaataagtttgatggaagttgttagtatatgttttagttggaataatattgtagtattttaaagtattataatagttgtttaaaggttttttttatggaaaatgtttttgggtattttatttttagttggtttatattagtagagttaatatttagagtattttattttttattgtttagataaaattagttttgaagtatttatttggagatgatggtttaggaaaattagtattttttttttgtaagaaatatggaatagataaatattttttttttttaagataaaagtgttttaatggttttattattggtaaattatgtgttagttatgtttttttttttttttatttttttatagtaattatatgaaatttttgtatttatgtttaaatttgaaaatataattttaaatgtagaattaattttatgggttatttagaaagtttttatttttttatttaataatttggattttgagagaaagagttttttttttgtattttttatttatatggtggtaaataataattttgggattttagtttagtttttttattgtattagattttttttagaaagtatggataaataaaatttatagttaatttttaaaatttattatattagaaagattattaagtttattttggagttggtaggataaatttttttattaatttttattaaatagtaaaagttattgattttagtttttgtttttttttttttttgtttttattatttggtatatgttaatataaaatatataatttttaaaatattgtaggaaaaataaagttaaagatatgtattataaatagatgtaattattaatttttggattatttagggttttatttgtatgattagtttagggattttggatattagtgagggttataggattgtatgttgttatgtgaaaagtttgtgtaatttttggtgttaaattagattttaagtttttgtggtatttggtataaatgtttatattgtgtttaagaatttttatatttaatatatttttaaataagtaaatatggttttatgtttgaaattattattaaggtatggtaggttaaaataaattaaaaaggatttttaaattaagtaatttaagtattatgtagttgagaagaatagatataaaagttttatataatatatatattaagttaaataggtgtgtaagtatatatattttattatattatatatatatatatatatatatatatatatatatatatatgtatgtattggaagagatttaggaaagagatgattatataaaggtagaaagatttgggtttaaattattatagttaaattaaagagaatggttgaggtagttttttaagtatttggggtagaaaaatatatatttattttagatatttggataattgtttttattttttatttgttttggttaatgaagttttgttatagagatagattagagattttattttattagttttgtagaattgagataggaaaatggtttttgttgtttatattggttggaataatgataattgggtgttattttgagttattttgattttattttgtattaattatagtaatgtatttattgatagtaaaatttgtttagaaattaagtttttttttttttattgagaattaataaatttagattaaagaaatatgattgggttggttttttataattgtaatatataaaagttaaaatattgagttgaaatgtatatttggttataataaatgtagaatttagaaaatttaaagttagaatttagtggttatttaaataaaaattttagtaaaaatgatagtttttttaattatttttggaattttaaagtatattaataatttgaaattgtattttttaatgtaagtttagtgtaaattgaggtatatttaagaatttttttaaatatggttataaaataggtaatttatttagaatgatttatattattttaaattttaagataggttttgaaaattatttagatgaatattttattttataaatttaaaatttaaaatataaggataagaagatattatgttatgtgttaatataaatttagatttttttttttttttatattagagtatagtgagaaaagtttttgtggaggatttttttttttttgtaattaattatttttgggttttttataattaaattggttagtttttggtaaattggaatttttttttttgttgtatatttagtgtgtatttatggtttttttaaaaaataattggttaggggaggtagaggtaggagaattgtttgaatttagggggtggaggttgtagtgagttaagattatgttattgtattttagtttgggtagtagagtgagattttattttattttaaataataataattataataataataattagtttggtgtagtggtttatggttgtaattttagtattttgggaggttaaggtgggtggattaggaggttaggagtttgagattaatttgattaatatggtgaaattttatttttattaaaaataaaaaaattattgggtgtggtggtatatgtttgtagttttttttgtttgggaggttgagataggagaattatttgaatttaggaggtggaggttgtagtaagttgagattgtgttattgtattttagtttgggtgatagagtgagattgttttaaaaaaataaaataaaataaataaataaataaaaaataatttttttattatttagtttgattttagggagatagtaggaaagttttatagaatttagtaggttttgggagtttttagatattgtatgtattttagtgttttatagtgatttatatatttatgtgtatttattagataattatgttaaattaggttataattatgttaataatgttaaagtttaagagtaatatagataattagagatatttataagttttgaagaatatgaataaatggtaattagtttatattttgaaagtaattgtgatgtatgttggtaaaatattatatttttttaatttaaatttttaggttgtgaaaaggtatttatataaaatgatgaatataaaatgaaaataaagatatataattatataatttaatatataatgatagaatgtaattatatagtatgttataataaaatatatattatatgttatataatatgtattgattatattataaaatgatatataatatttattaaagatattgtttattagatttaattttaaaggataggtattgttattgtattatatttattttatatatgagaaaattgaatttaatgaggttaagttaattattaaaggttataaagttattaagtggaagaataaggtttgaatgtagatagtttaattttaggtagaatatttagtttatggttgtagtatattataattaaaatttaatttaaatatatttaatgtgataaaataattagtgtggaaaagttaagttgttggttttttatttttttggtaataaatgtttattttatagagtgttattgatattgattttgttattttatttttgtttatgttatatttatggttggtttattataagggaaattatagtagttattttttttttagttatttaattttatatagttataattataatagtaaaattaataaatgaattgtattagatggtttgaaagtttgattttataatgtgttttttggtttaaaaataggtaaatgaaattttgatgtgtgtttttttgttttttaaaataatgtataatttatatagttaaaaatagtttatttagaatatttaaatattttagattataatgtttatatttataggatttttttataaattttattatgttattttataaaattgttgtgaggtggtagtataaggattgttatttttattttataggtaaaggaagtttaaaaaagaaaaaaaatatatttttaattattagttataaagttagaatgtggttagatattagtgttttaaatttaattatatgaatatgtttttttttttttgatgtttaatgtttttaaagatagaagttagattatataattttgtattgtgtatttttattattgttggtatatggtttgttaaattaattaggtaatttttttaaaatattttgagttattgataattttaagttaagttagagagtagagtaatattttagtttgtttaaaattagaattttattaatagtttttttttttagtttattttattaaataagataaaaatattttagttttattgttgaaaatataattaagaaaaaatttaatgatgtaaaattttttttgagtagttttattatttatgatttttgtgtagtttgttatttttagttttgtgattatgtagtgtttttttgagggagttttttgtgggtttgttttttatttagtttttggaaatttaatttggttataaaagtttgggtatattagaatgaaggaaatttagaaaaagtttttattttttaaatttattattggtttatgaagttatagagagattttagtgtttttgaatttttataatagtttttttaattttaattgttattattgggattaaatgaaatatatatagagagagaaagaaatgtttaagtattttgtaattgatgtttagttaggatattttattagattagagtagtaaggtatagttttaaattttttttttgttagagtgtttttttattattatgtttaattgtatattatatttttataattgattgtagattttggtataaatttaaaaaaattttttttttttaaaaagtataatattattttaattgttatttgtttaatgttagttaatagtgatgattattgtgtggatatgggaagatataagggagtggttgaggtttatgtgtattttttagggtatttttgaagagttaatatttttatttaaaagtgtattgggatgtaagtgagtgagagttagtatgttattaggataattttgaatttattttattttttgggaaaaaaatgtagaaatttttgaatttttaattttattagtagtaaattatttgtgatatattagagtgtagagattttttgtgtaattatttttagaatggtttaatgtttgttattttgaagaatttatttttgagtatttgttttttgtatttttagtgatttttaataatgagagtttgattttgttttttttttatatatttttgagaattttttgagaagaaaggaattgttattgatagaaatatgttagattttgttgatgtgtagggtttaagtaatttggaggattattatttgatatttttttatattgtttggtagatatagtgattaatttaaggaaatggtatttttttttggaggagtttaggaaggtttttttggtgattgtttatagtattttttttttagatttaaaattttaaattatagataagtaaattttggtaaaatattaaaaattatttaaattgtgtttaaaagaaaaaaaaaagaatatatttaaaattaggatttttagtttttattaaaaggatttaaaattttatatgtttaaaatgttaaatgttttatgattttttttttattatttattgtaaggattgaatttataataagtagttagtataggtaagtttttttagtttttgttttttttatttaaatagttatttttagggggtagtagtggttataaaatggtataattttaataataattatttttagttatgtgtaggggaatgaggtaggtgattattttgttaattatatggttttttataataatattgttgtattaatatatatatattgttgttaaatgattatatggttttttataataatatttttgtattaatatatatatattgttgttaaatgatttgtatggtgtgatttaaaagttgtggtttttggtattaggtaaattgattagatatttattttgtttatttaatttatggttttaggttagtttattaattattgtaagttttaagttttatatttatgaaagagaatatgagtagttatagtttatatattgtttatggtaattttttataaatattgttttttatttttttttttttattatgaatgtatatattgatataagaaataaataaaatataatttaagatatagtttttataaaatagttttaattgttgattaatttttttaaattattgttttaatttatttttattatttttatttttagaagtttttaaggtataattatatgttttagtagatagatttgtattttgtggaatgaaatttataaaggatttatgagatttgttttatttatttgttttttgaggagagattttagttataatgtttgttttttagaaagttagttattgtgtatgagggaaaggttttaattgggttatagtttgtggtattggttttttttttttggttttttgtttttagtgtgtaggggaagatatttttttgtgtttatttttttattttatttattaaggaaatagggtaaattttttaagtgtatggttttttgtttttaattgggtatttatattttttttttagttttgatttttttttttgtaggtaaaaatagaaaaggtggagagaaaaatatggtggatttttttttttttgtttgtgtaagtttgtttttaatttggtgattgttgatatttattatttttgtgaaagatttttttttttttaatatattatattagatttgattaatttaattttgtagtttttgtagttttttttatttttaatttagtttttagagtatgtttttttttttgaaatatgtaaatatattttgggtataaatattttttaaaatataattataatgttttattaatattttaaaaatgtttagtgaattaatttagtatattatataatggttaagtgaaagttttgtgtttttatgttttgtttttttttgaaattatatagtttagaaattagtttattatttgaaaaatgtatgaagaattgatgaattgtataatataggagtattgttattgaatgtattgtttgatttatttaagtaggtaatgaataatgttgttaaattttttaatgagatattataattaggatataagttaaaaggggtattattttggtagttttttttttttaattttagtattatatatattttttggtatgaaagaatgaaaagtattagtaaataattgaagttttattatggttttgtagggtttttggaataatttttggaattggaaagtgaaaatggatagtatgtgggggaaatttttatttgagtagtaagattttagtaaagatgattaagttattaatagtatgtatttatatttaattttattgatttttgttattagtttttgtagattgtttgggtggaaggttgtgatttttattgggaggatttgagtagaagtggatgattaaaattgaggagtatataattttttttgggattgtttaaatgttattgtttgaaaatatttttattttttttttttggttaaagagatgtgtttaaaatttttatttttttataataaataattttgatttttttagataggtttgtgtttaggtatgagttttttttttattttatttagtaattttttttgtggttagaagaattttgaagaaagttttgagggaaatgaatataatttttaaattattatatgtgtgtgtatatatatagtttaattttaaaaataatttattagttattataaagaaataaatgtttttggtttaagatgttatttattttttttttttatattttttagttttaattattgttttaaaaggagttattttagaatttagattagagatttagattaattgttatttttgtaagatgtttaaaattaatttgagaatttttatgtgtttgtaaatagtattatggagatatgtatgaattgtattaagggtatttttttatgtagtttatattgaaattatataattaagattagataggaatattttttattttattttattattatattttaagttttagggtatatgtgtataatgtgtaggttagttatatatgtatatatgtgttatgttggtgtgttgtatttattaatttattatttagtattaagtattttgttttttaaagaaataataaaaattttaaaggaaattataggatagatgtgatttgtattagaaagggaaggataattttaaattatattaatattaagtagaagaattatataggtttatttatttttttttagttttgtttttatttttaattgggatttaaatttatttttattaatattagaggttaagaaaattattatatttttattaaatggtagagatatttaataagatttagttttattttagtataattttaaatattaatatgattagaaaatattgatttatattttaaaataggatattggagttattgttttagataatttttaaggtaagaataagtttgtaataaataatgagattttgatattttttggtgaagaagatgttttttgttttaatatgattgttatttagtaattttaattttatgtttatttgatttaaaaagggaggataaattgttttgaaaagttttttgtttttttaatattttaaagtttttattgaaatttgttgttttggtaaaaataaatagttaattatagaatatttttatgtggtgttttgtttttaattatttattagggaattattagtggaaaaaagaatgttattagtgttttttttatttatattagttttgtagtatgaatatttatattaaatgtatgtgttatatgaattttttaaagggttagtagttttggggggtttatttttaattatagttgtttagaaagttagtgtttaagagggagagagtaggttagggttattatttaagtagtggtattaatttaaatgatatgtggggtgtagttatagttattttatattttgtttataaattgagatatgaggattttaatttttagttttttatttaatttgatttattaaaaaaatgaattttgattattgattaagaaaatatggttagtttattatgtgtgaatggttatttggaaaatttatatattgtttttttattatttttttttaaatgtttaaatttttttttattgaatgttattatatttttaaagtagaaatgatagaattgattaattatatttttttttatttttaaaaattagtttatatatgaatgaaaattgagtaaaaattaaatttatattttgtttatatataggtatgtttttttaaaaatattagtaaaatttaggaaagattattaaatatatttatagtaattaataaagagtgggaatgtattgaatatgaatttataaatggatgatgtgtttatttttatttatttgagttaatattgaaataaagatttaaaaaggtatgattggttaggtatgatggtatatattagtattttgggagattgagatgggattatataagtttaggagtttaaggttagtttaggtaatgtggtgaaattttatttttataaaaataaaaaataaaaataaaaaataaaaaaaagttatgattagtatgttatagtttttgttatattttttaaaatatttatttgtatataagtaatttatattttttttaaaaagaaaagttagtaatggaaatttaataatatttttgaatgtgatattgataatgttgttttaaaaatattgtttttaggatagttgttgaaaatttggttttatgataaattgattaggtttagattttaattttgatatttatttgttgggtgaatgtggttattttatttaatttatttttgtttgtttttttatttgtaaaataggaaaaataatagtatttatattatagggttattggtaagaattataaaagatttggtagtgattttaatataagtatttagaaaaaagtataatttttattaaaatgtatagtataaattttttttttttgaatgattaataattttatattatgtaaattttatattgttagtagtttaagtttaaagagaataatagtgtagatttgttgttatttaggtaattatttggaagttttttgtagataggtatatttaagttgtataatttaaatttgaaaatagatgtttttttattttgagtgtgttatattagaaaattttgtttttgattttatttttgtattttgttattgattagttatgtatttttgataatagtttttatagattttggtgtttttttgtaaaatggattatatatatatatatatatatatatatatatatatatatatatatgttttagtggatttttaaatgtatgtgatttattttaaatattgaaatgtttttattatttgtttgtagtgtatgatttaattgtaaaaatgttgaaaatataaatttagagaaagagagtaggggtgtggtaaatgagattttgtattgaattatgaatgatagaatgataggagattatttaggttgtttttttagttttttattaggttaaaaagtgatagaaataggttttagtagttgtttgtaaatttgtttttagttaattttgaagaatttttaaggtaagaaatataatattaataaggattttgatagattattatttttgtatgttttataggtgaaattttatggaatatttttagttagtattttttaagaggaatttttaaagtgagagtgaaagaatataatgggtgtaaaataagaatagtaagagagggggttatgtaaataggaaagaaagaatagtttatagaggtagttattatttgaagtatagaaaggtagtttaaagaagggtagtaatttgaatattatgattttgaatgggaaaataagaattaaaaaaattaatattgaagtttgttttgttaattgtaatgaaagaggaatttaattagttggataggttgagtataattagtggtatttatttttgatgatattttgtgagtatttgaaagaattaggaaatagaaatagtataaatagtagggatatgatatatgagtgtaataaaatgtattttaaaaatttgagagtatgggtagggggaggtggtgataagagaggagtgaagataaaattgtatttataaaagtataaaataaaaagtatgttttaaataattttttatttttttttttatattgttttttttttttttttttatttttttttaattttttaatattaatgttagtgagaaaaatggataaaaagattttgttaggtttagttagaaatatattttagtttttttttttttaattttagatttttaataattatagttaaagaaagaaaaaagaaaaatagaagataaatttgttatttaatgtatttaggtatttaaaattaggttagattttaatagttttttttaattgattaattttttttttttatgttaattttggggtaaatagtttttagaatttttagttatttggttgagaatagtttaagaaattggaaggagatattagtaaagtaatagtgaaataagttgtatgtattaggttatttgtttatattttttttggttttttgaaggatttattgagagtgtatggtaatggaaattaaaaaaagaaaaaaaaaaaagaaagaaagaatttagggttagaattatgtatggttgggttttttttattgataaaagaattagaagagtggttagtttttaaatgtttttttttgtgttgagaataaagtagttttgttattttattttttattttaatatttttttgtttattttaaataaaaaaaataagtaagtaatattagtttatattgtttgaaaatttttttgttgagagatattgtagggttggttttgggttgaagtttgattgtttatgtttgtttttgtgttttattttttgttataaattgattttttaatatatagagtatttttatatttttaaattttttttatttatattaaaattattggaaaatattttattttttatgttgttttataaattaaagagtatttgagataagttttaagaaagtttattttgttaaggttatgaatgtatttgtgatatagttttaggaggttttgatgatttgtttttgaggttgttgggatatagtttggttttatgtattttagggggatatgagatattaattaatatatgtaagatgtatattggttttatttgggaaggtgggataatttaaaatggggggtttttagattagaggtagatttaaggattttttgattggtaattggttgaaagagttattattaatagaaaagaatgtttgtattattatatagatttgtgggtggtggaaattaaggtttttttttgtagatgaagtttttaggtagtaagttttagaaaatagattgtaaatgttttttattagatttaagaagtttgttttattaataatttttaaagggaggagggtgtaatgaggtatgtttggttgtttttttttattattttttgaattagttttttaggttatttttggattgtttttgttaagaaaagggttttttttagatggttggggggtttagaattttatttttggtttattgtttttgtttttttttaagtaataagtggtaaatgaatattttgtaaatagatttttggaatgattgataaagtattaattaataatttttgttaggtagttaagatgtttagaaattttttaaagaagtaatgataataataatattgttaatagataaggttttttgatggttttttatgtattaggttgagaattatattttttaaggatattattttagttttaataattatttgttttgttttgttttgttttgttttgttttgttttgttttgttttgttttgttttgaaaaggagttttattttgttatttaggttggagtgtagtggtgtaattttggtttgttgtaatttttgttttttaggtttaagtaatttttttgttttagttttttgaatagttgggattattaggtgtgtattgttatgttagttgatttttgtattttttgtagagatttggttttattatgttggttaggttgtttttgaatttttgattttaggtaatttatttgttttggtttttaaagtgttgggattatagatgtgagttattatatttggtttaaaaataattttatatgtttggtttttattatttttgttttatagatgagtaaataggaatttaatgattttaagaaatttgtttaagataaattagggtatagaattgaaagttgagtttattttaattttaaaatttttgttttttaatataattatgattttaatagtattattttttttaggtatttttggggagatatttgtaggtaattattagatggaaaaatttattttatattagtggaattattattgagtaaaatttttatattagggttttgaagatattaatataattttttttatttgtttttttgattttatttttttatgatgatatagtattttaagataattggaaaaatgaagattgtattgtggatgataattatgtttatagaattgtttgaatattaattataataaatttatttatttatatattaaatatttatgaagaatttattataagttagatatgtatttgagaaaataatggataagtataattatagtgttttgtttaataatattatttttaaatgagtggatgattgaattattatgtatataatgttttaataaatatattaataatatgtagttttattttgatttttatgaaatattatttatttgatattttaagaatattagagaataatagtagggaaatgatttatattttaatggttaatgattaatttatgataattttgttttaaattttttttaatgttttttgaatgttatatttttatgtttagaaaaagtaattgaatgtatgtattatagggttttttttttatttgagaaatttttttattatttatttttaattttttattttaatattttgaaatattttatttagtaattgatttaggatgttgtattatgtgaagtaatgaattttttggttttgattaagaatgtatattgtattttaatgtgtttttttatatatgaaaaatgtaatatgttttttttgaatattaaatgtgttttgttatgtgtttatttttaattatttaatattaagaagtttaagtatattattataggttataaatttataaaagtttgtttgttttttttatatgtgatatatttttaaataataaaatttattgttatggatagggtatgtgttttgtgttattttaatattggtggtgatgtgtttttgttgatttgtatatatttttttttttgggattattttaaggaaatgggtgaaggtttggggtgttggttatatttttgtaaatattaatgtttttataaagaaaaaggttatttaagttaagtaatttaattgatatataaatataaaggtatatattttagttgaaagataaagataaatgttttttttagtattatattaattatgaaaaatgatggtgttatttaataaaaattattaattattatattaaatatgtttaaattaattgggggtggatttttttttggtgtaaatagaataagtgatatgtatgtttagttataaatattttgaaatgtttatattaggagttgtttattaattgagagatttttttagtttttgaagtgatagatgttattttattatttaaaggatattttttttttatttttatttgttttatttgaagataaaaagttttttaaagtttaaaaagttgtgttttatttattttttaatttttattttttagtatagtgtattgttgaaaggaaaaaggaattatattggtattgagttatgaagtatttatgaaaatttatttttaatattgttttttgttttgttagaataatttttttaagattttttaatataatttgaggttttaagagtatttttggtatatttttgaattgataattattttttatatattatataagtagaaatatttttaatattatttatttttatgattataattaatatgaaatgtattatgtaaaatgatatatgaaattatttttagaaatttttattttaagtaaaatgaattatttataatatttagagttataagaaagtatgtgggttagtgtggtggtttatatttgtagttttaatattttggaatgtttaggtatgaggattatttgagtttagaatttggagattagtttggataatatggtgaaatttagtttttgtaaaagagtatatatatgtatataaaaattagttgggtgttgtggagtgtttgtagttttagttatttgggtggttgagttgggaggattttttgagttggggaggtagggagaggttgtagtgagttatgattatttttattgtattttagtttgggtgatagagtgagattttaatttaaaaaaaaaaaaaaaagttataaagaataaagaggatgtgtttagttttggggaggtagaatgataatagattaaatgtttttatatttaaattgaattgtgttattatttgatttatgtatttagtaagaatttattaaattatgttatgttataatttgttaggtttttttggtgttaattgtatataatgagttagagattattatatttgtataataatgttatttttaaatgatagtatttatttttttttttaaaaagagatatatgaaattatttagtgaaaattataaatgatattattttttataatttatatttaaaagaaatgtagatatattgattatattggataaatgttttttagattaatggttagaagatatttttatattttaatgtgtgtttgatttattagatggaatttattgatttattatttatatttttattttaggttttttaggttttttaggtggtttgagaatagaagatattagagttatttttgtggtatttatttggagttgtggtttagataattatagttttatttttaaatatattatttagattaagattatttttttagatgattggaaagatgtaaagataggtgagttttatttgtttgattaatttgtgtatgtttttaaagtgaattttttttttaaaaataaaaatttggaggttttaaaaatgttattatttattttgaaaggtttttttttttaaattttttaaaatgtattttaatattttggtaatgaagaaaattatatagaatttatatatttaaatgtgttaaagttatagaaaaagaagtattatttttaaattaatatataatggaaagtaaaatgaggttttttgggttttttatttgagttttgtgtgagatttattgttttaaaattattgggaagtttatttttgagtaaatagtatttatagtatagtatttatgattttttttatttgggtatatatgtattatagttttgaatttttaaaaaattatattgattataaattttaaattaagtatttaaattttattattataattttttatgtgaatgattttatttggtttgaatttttttaaaatagatttttaaagatattttggattttttaatttttttttttttttatattaagattttttaaagttgattgggaaaaattaattaagaataagtgggtatttttttttgtttataattttgttatttgttatgattagtttataatattatatattaatatatatatttttttttgtaaaatggaagattgaagatttttttgataaaataatttgtttatttttgtaatttttgataatatttttaaataaatttgttattgttagaattttttaagatggaaaagaggagatatagaaatatttttttagttgttataagaggagaaatgagatatgagtgtgtgaataaaatgttttttttttttaaaaaattaaaaaaaaaaaaaatattttaattttttaaatttgtttttattttagatttattttaatataatggaaattttatttttaaaatgtttatatttgtattgtttattaagatattttaatttaaatttatttttatttgatatttttttttttttagggaaataaattaaatataaatttgaggtttgttgtaaggatttaggatatattttaatattagatgattttttatttaagtgtataaagttgtaataaattagaaataggtgaaatatttttattatattatgtttattgttttaagaattatttgtaaatatttttgataaaattagattatttgaaaaataattttaaaaattttttagatattttataaatttaaagtatgggtagtttttatttttttgaagagaatggaaaagtatgataataatgaaattattagaaatttagttatattaaaataagtaaatggtttaaatttggtttggttttgaaaaaagaaatattaattgtaattatttttattatttatgtatgtttattatgtagtttaatttaaatatgttttttattttaaaatatttattagaaagtaagttttatgaaggtaaaaattgttttatttattgttttatttttagtatttatattagggtttatagtgtttatttattaaatatgtttattgagtttttattgtgtgttagaatttattttagatgtagtatgtataggtgagtagtagtgaatataataataataataaaatttgtttttaaggagtttatattatagtagaagagatgttaatatagaattaaaatatatagtaagttatgtggtgatgaatgttagagagaaataatagaaaagaggaatggggaagtaggagatgtgttttaaatagggtattttttatatttttatttataggtgggaattgaataatgagaatatttggatatagggtggggaatattatatattggggtttgttttggggtggggggaggggggaggatagtattaggagatatatttaatgtaaatgatgagttaatgggtgtagtaaattaatatggtatatgtatatatatgtaataaatttgtatattgtgtatatgtattttagaatttaaagtataataaaataaataaataagtaaatagggtatttttgatattagtaatagttattgttgttttttgaaagtttttatttttattatatattttttttaatttttttatttttattgaatttgggtttttgaatttaaagtatgttttttgttggttatatatagttggattttttatttagtttgatagtttttgttttttgattgaattaattaattaatatttaatgttattattgatatagttggattgtagttgtattgtatttttgttttttaaatattttattatttttgttttttttttttttgtttattgtttttttttggaagaagtgagtattttttagtgtaatattttaatttttttgatgatatttattgtgtgtgtgtgtgtgtgtgtgtgtgagtgtatgtgtgtatgtgtgtatatgtataattttgttttgaagggaagtttatatttattatatatgtgtatatttaaatatatatatatttaatgaatattttagggtttattagatatatttgaatttattagaataggttttataattttattagtttaaatttttagtgaatatgaaagtgttttttttatatagttttattttatttttttttttttgtgttattatagtattatatatatatattatatattatattattatatattaatagtatatatagtaatatagttatatattattataatattgtatattaatattttgttatatatgttattatagtatattttattatatgttattatagtatattttattttatgttattatagtatattttattatatgttattatagtatattttattatatgttatgttatatatagtaatatatatattgttataatagtatataatatatgatattaatatttagtaatatattattaaatatattatttatatatagaggattaaatatattatgtataaaagaggaagatgaaataaagttatttaggggaaatatttttatatttagtgaaatatatataaatatatatattatatttttatatgttataaatttaataattttatattaatattattattttttataaatgtttgtttattaaattaatatgtttatattattttttgttaatttgtttgttatattattttttatatttattatttttaattttttttatttgtttatgttgatttgaattttatttgtttaagtttattttgtattgttataaagaaatatttgaggttgggtgattttgaaagaaaagagttttatttggtttatagttttgtaggatatataagaattatagtgttagtatttgttttttgtgagggttttaggaagtttttatttatggtgaaagtaaattggtttgttatatggtgagagagggagtaataaagagagaagtaaggtgttaggttttttgtaataattagtttttgtatgagttaataaagtaagaatttatttattattggaagaaaggtataaagttatttattgggaatttatttttatgatttaaattttttttattaggttttatttttaatattggggattaaattttaatatgagatttagagtggataaatatattaattatgtattattatttgatatgatttttttataattttgtttttatttgttttttttgtgtagttagtattaaatatattatatttaaatatattatagatttaataagataattatatatatatatgtatatataaatgtataatatatgtgtgaatatatatatatatatatatagttttttataattatttttaaataagttaagagaagatagaagaaaaaataagtatttatattattttttataattataaaattatttttattaatgtttattattttgggggagtttatttaaattgttgtttgggattaattatttttaatttgaagaattttaatttttttttgtaagataagttttttattaatagttttttttagtttttgtttatttaggagtgtattttgtttttggttttaaaatatatttgtttggatatgatatttttggttgatagtttttgtttttttttttttttttattgttttgaatatgttattttagatgttttttttaggttgagaagattgttttttattttatttgttgaaaagtgttttaaaatttttttatatttattagtatatttattatatttgggttttttatttttttttgtaaaattttttttttatttggtataatttgtattattaagaaatttatagtattttaaattgtttaggttgttggatttaaaggtttttatattttttttattagaaaatgtttttaattttatttttaagtattatttttattttatataaaatttaaattgttttttattttattttgattattttaaaaatattgttttgttgttttttgtttttattgttttgggtgagaagttagttattgttttaattataattttttgtatttgatatgttttttttatgtgattgttttaagatttttttttgtatttgttttttagtttgataaaatgtatttattttaatggagtttggttttttgtatttttaggttgatattttttttaattttggaaaatttttagttatttattattttttgaaatattttttttgttttattttttttttttggttttttttgatatatatgttagattgtttgatgttgttttatagataatggatagtgtgtgtgtgtttgtgtgtgtgtgtgtgtatgtatgtatgtgtttgtttatttgtgtgtttgtgtttttgtatggataatggttaatttttttttttgtttatatagataatttattttgttggatttggtttgtgaataattttattaaaatatttttgattttttgttttattgtgtttaggaatttttatttttagtatttggttgtttttaatattgtttatataatattttatgggaattttttatttgtttatataagttgtgtatgttttttatttgatatttttatatatttaatatagttatgttaaaattttatgagatgatttaaatatttagattattttaaagtttagttttgttgatttatttttttttttttgatagtgggttatatttttttgtttgtttatgtgtttgataattttttgtttaattttaaatattgtgtatagaagaatagtgattattaaagtaaatattaattgatgtttgggaaagtgtatgttattattttagggattgagttaattagatttgtagttgagatgatttgagtattgttagatttagtttagtataggttttaagtaatttgaatgtatgattagattttttatatatttgagtgtttggaggtttttttgttttgttattagattttggtagatttttttatgttggattttatagagggtttttttagtttttttgtttttgtttagatatttgttgttgataattagtttaaagtttagagtgtttgggttttttatttagttttttttttttttttttagattttaataggtttaaagtatttgttttttaaggggaagtagattttttttagtatttttgttattattttatgtttgtagtattggtgttgtagagggaagttttttttggtttttttgttttgttttaaaatttttttgagtatatatgatgaaggtttatgaaaaataattgttaaattattatagattttttttgttttttgatttttttatgtttttaaatagttatattagtttatattttgtttgtaaatatttgttagaagttaaattgttttttttttgttaatatttgtgattataatttttttttattattgttttattaatgatgaattttagtttattgtgtttttataaatttagttttttaatgggttttgaaagatggtggtttatagattatttatgtgttgtttttgttagtgtattagtgaagtttttttgtgattgtattttaagtggaagtgaaaaatattttttgtaataaatatagaaataaaaattatatggtttttatttataatgtgattattaggaaataaaggtataggattaaatttagttttatgaaggtaaatatttaagatatgaaataaatatgttttaaagatattaatttttagtgttttaaagattaaatttagaataatgagatgaagaaatagattatgtatttttaaggtaatttattgtaaattttattttttttggattgtttttagtagatggatagtagatagtttgatgttgtttttggagttgtataagatgtttaggttgttgttagaaaattgtgtttgattttatgttgttgtttttagtggataaatgatagaatattgttagtgatggtgtgtgtgtatgtaagaagatgttggttagaatatgaagaggtatagtaattatgttatgagaaatagttaagagaatttggaatagattatgtaatatgaagaaaatatgtttatatttaaatttttgtgttatgtaagattgagttgattattaaaatttttttgtagttaatatttttgtatataaatgtttttttatattttagattatttttttaaaatagatatttgtaaattaaattgttgagtgtaaatagttaaaatttatgagttgtattatataattgttttgtaataaagtagaattagtttttatttttattattagtatttgagtattttttttgttatatttttatttagtattagtattatttttttaaaaatgaaaattttttaggtttattgtaggatagtattttttttttttttttgtttttttgtttttttagtttttgtagtttttattttaaatatgaatttttagatttttatgaggttatatttgtattttttttagagaaggattaaggatttatattttttgagatgttagaatatagtttgttttatttttgttttatggaaatttgtttaatttatggttttttttagagttttgttaggtgatttatgggttgggtttaggatttgtaatataagattgagtaggtgtgttagaattagtgagaagtttttaaatttttatttttagttttaaatagatatttgaatttttatttagaatttttgagtgagtaggtttgttttgtgtatttataaatatttgggttttagattgaaatgggggatattaaagattttgtttgtgtttggattttaaagaaatattaggatttatttaggtaatttgtaaaagtttataatggaggggtttatattggttggagttatttttgatataatttgttttttagttttgaagttattttggttgtttttaaagttgtttaaataattaattagtgtgttttaaaggtagggtattatgagtatgatttttaggtaattaaaatataatgaattattggttttatgatatttatgaggtttgatttttttttttttaaagaatggtggaaatttttttttattttaagttttagggttttaaggtatttgtaaatagatttttgaattattgtttatagttggttgttaaattgagtattttggtttaagtattaaagtaagaattaaggttttttgttttatatttttttgtttaaaatttatattaaaagtaaaataaatttttaaagaattatttatttaatatataaagtttagttttttttaaaagagagatgtttttaataggtattatattgttaagatttgattttttattgttgagattaattgtattgtttgatttagaattgatttggttaaaaattaggtttagaataaggtttgtttttgatttatttttagtatttgtttttattatgtaaagtattttattttttttttggttttaagaataataaataggttgtaaggaatttggttgaagaaaaaggatataaagtttttttgtttttgtttttttttatttggtttgaggtataaatttgtttttaaagtaaagttgatttttttagggagtaggtttttgtttttaaattgtataggtgattttggaagtagtaaaaaaagaagaaagagaagaagagaaaaggatttaatagtttttattagggtttaaggaataggaaagaagattgtattaggtataagtttatttatgaagatatttagggtttataataaaatatataaaatgtgttttaaaagtaaaattatgtttttaaaaagtatataaagtggtagtggaagagataaatgagaattaatttataattgaagggaaaggaagaggttttaagaagatagagtagtattatttgttttagataggataggataatttatgggttgaatatatgataatatagagttatggagtgatggatattatgtggtggggtaaggtaaaatagtgtttttttttttttatttgtttgatttaaggatggagaagatattaaagtgattgatatagataaagttatgttttttgtattgagatattgtttattttaaatagatataaattttagaatttgtattatatatatattttaagtaaaaatgtattaagtatttttatttgtaaaatattatgttgggtatattaggttttgaggggttttaaaatatgaataaaaagtagaagaaatgtatatatggttataaatgatagttaggaataagtaagggggagatagaagaagtatattgagtgtgggttttatgtggatttagttagttttggagttttatttgtagtgatgatatgggttatttagtttaagataagagttgggaaaatagatagaaagtgttttaaattatgtatttttgatgtggttggggttagaagtgttattgagatttgtagaagtgaaagtagtttagagagaagagatatttttaatttttggtatattttttaaaaatgatagatgttaattatgtttttgttaaattatttttattatttatatagatggttttattgaggggatattataattatttattaaaatatgtttgttttagatatttgtatttttgtaggtattgatgttaatataaattattaagaagaagaataattgggtttgttttaaaaagaagagttgttaagttattagtaattttggtgggaatattatttttaaatatttatagtaaattttttttttaataatttagaatgtttattttggaattttatttttttaatttgtattttgttttttttttttgagagagttttatgtgtttttggattaaggggttttttttagggtttatttgtttgaggttatgattttgagtttggttgtttattttttttttttttattttatttgttaaaattaaagttttggttttttagttggaatttagatttagtataaaatgatttttgttgattttttttgttttatttattattatttttttatatatttttggtggttaattatgattttttattttatgaaaatgttttttatttgtttgggatatttttatattggatttttatattttttatatgtatttaaaattagttaattaattgtagtttttttatatatttatttggtttttttttgtttgttttagtagatatttgtttttatttgttgattttttagttttttggaaaagttttagtgtagttttgattattataagaatataatatttttattttttaaaatgtttttaatatttttatttttaaaatttttaaattgtgttggagttttgggattaggaagtaggggagtaggttagattgttttaagttttttaaaatatttttgtattgtatattttttaatttttgttaaatttaagaattataaatttataaatagttttattagtttttgtttttaaggtttagtattagttttttagggttgttaataaattaatataaatttgttagtttaaaataatagaaatttatttttttatagtttggagattaaaattaaggtggtggtagggttgtattttttttaaaggttttattttttgttttttttagtttttgatggttttatatattttttggtttgtggttatattatttttatatttattttggtggttttatggttttttgtttttttaggtgtgatttttttttgtgttttttttttataaagatatttgttattggatttagagtttatttagaaaatttaggataattttattttaagatttttaatatttataattttaatttgagggtttgttaagtttttttttttttttatataagataatatttataggttttggtaatttggatatggatattttttgggtggagaaaggtattatttaatttaatatagtttgttttttataaggggttaaaattattgaaaagtgtttagtaaaaaagggttattttggttgggtatggtggtttatgtttgtaattttaggattttgggaggttaaggtgggtggattatgaggttaggagattaagattattttggttaatatggtgaaatgttgtttttattataaatataaaaattagttgggtttggtggtataagtttgtagttttagttatttgggaggttgaggtaggagaatggtgtgaatttaggaggtagagtttgtagtaagtagagattatgtaattgtattttagtttgggtgatagagtgagattttgttttaaaataaataaataaataaataaataaaaaggttattttatttagtgttattagttattattttattttgtaaatagttttttataaattaaaattttattttattttttttaattatttagaaaaatgtttttatgtatgtgaattaaaataaatagtttttgatttggtgtgagggaggagtgaaagaggagataaagaggtagaaatttttaatgaattttaataaattaaaatagaggtgaaggtaaagggaaaattttaattagaaagttaaaaatatatgttaaatttatagaataaatttataataaaataagaaattagatggtaaaagtagtgtttagtagagttaaaattatggtagggtgagatgggatagtttgagttatgtgagaatttgtttaaaagtagaaattggattttggggtgtttagtatttattgtgttgatggatatgttatttttaaaaattatgtatttatggtttatattgttagataaaatttttttaaatgataagatattgtgttatagataagtttataggtataggtatttatatggataggttgattattaaaaatttgtggaaatatttgaggtaagtttataataatgtatagatttattttggttgtatgttttattatattttaattaaataagtaagttaagattatattttatttataatttattatttaatttatattagtatttagtagtatgaattttgagggatatttaataaattttaataaaattattatgatatttattattatttgtttaaatgatttgagtataaatttataaaattaagtaaaaaggatataaatattaattttttttatttagttataaattgtttgttagttatagattatattagtggtaatatataaaattttgttgttttaattgtatttttattttaggaaatttttttagattgtatttttagaatatagttttttgttatttaaggtgtagtttatggattagtattaagtttggaggtttgttagatatgtagaattgtagattttttgttttaaatttatttatataggtgatttatatgtatattattttttgtaagtttattatatattaaatttttttttttatttttttgaatttaatattttgttatttttagttgtagtttttattttaatttagtgtaatatatattattttttttgaaatagtaaaataaaaagggaagttataaaagtgataagttaattaatttgtattttttatttattatttattttatttagattttttaattattgaaggaaatatggaggtagtaagagtagtggatttaattttatggatggagtatgaattttgtgtggtagtaattaatatattgggtagaggagagtttagtatattatttaatagaattaaaatagatggtgttggtatgtatatataagaaatttgaaattttaaaagatttttaaatatagtgttatttttatatatggttgaatgtatttgaaaataatgttttgaggtaagtgatttatttgaaaagtatgtgtgtgtattttattattaagatagttaaaaattaaaagaggaaatatgaagtttaagaatattttaagatagttaaaaattaaaagaggaaatatgaagtttaagaatatattaattaagaattaatatagaggaagaggtgaataggaattattgaaatgttattggagattattggaatgatgtaagtatttagattataaattttaatgtaaattttgaattttaattaggtagatttttgtttgattaaatatgttttatgatttagaaggtttataattttgtgttttttttgaatttatttataattgaatggttaagttggtggatattttatggtaaatattaattgtaattaaatagtgttaaaattttaggtttgatattatttggaaataatttttttttaatatttaaggataagtagatattatggtaaatattttttagagttatatgtgaattattgatagtgagtatattatttttagatatgattttaagtatttagagtttagagtgtttattattattttgtggaattagttttagatatgattttaagtataaattatatttagatatttaggtatgaaagaattagattgaatttttttgagatattgtttttgttattattatttttaaaaaatatttaatgttgttatttttattttgagattaaaaaataatttaagatagattttatggtaattatgtttagatgatgagtttatatattgtaaagaaattattttttgagataaataatatagataatatttgtaataaaattttaagaaagaaggagggaggtttatatttattattagtgttaaagaaagtattttttttttttgatgatttttattttaaagaatggtgtttagttaagatttaggttatattgtattagttaagaaattatagaaaattaattaaattttatgattaaaggtttgtatttgagataggtaagtaaaaatattttatttgagatgtttgtttagattaatttaattatttagtatttttttgtaattttagtgaatgtttgttaaattaaattaaatatatgatttgttagtataaaattatataggtaaattattagtggaattatgttatagtttttttatatttttgtttttaaagaaagagtaatagtgtttggtttataatatagaagtttttattataaatatatgtagttttagggaataataataaaaattaaatataagaattttggttatgtggtatttgttttttataaagttttattttagattatttatatattttgatgaaatttttgtgaggtagagaaaagtaaatattagtgtttattttgtaggtggatatgttaatataaaaaatttagtgtttaggttatatttagtattatagttaaggttgaaatttaagtttttattagaattttaataaagatttatataaatagatgtgtttttagaattttgtttgagaagttgattttgagaaaatttaatgtatgagaatagttgttagatttaaatttgaattttgaattttgtaattagttatattaatttagataaattatttagtgtttttgagtttattgtttattaatgaatatgagtataggattatttatgttaaaatgttattatgaggattaaatgaaatggatgtgaaaatattgaatatagattaagtattttagtgttttggttttttaattttagaattatttttttttatttaataaattatattaaattatatgaaattttaagagatagtttatttatagtagtttttgtttaaagatattagaatttataattatatttagaagttaggttaaggaattgaggtaaatagaaatgtagagaagtgatattaagagattatagtagtattttaatggaattttgttatttatttaaaattttttttatattatttaaaatattgaagtttggtaagttttagttaaatgagtttagagaggttatattttttttttgatatagggaataataaaagaagagttattattagaattagaataatatttttttttagtgatataggggagaaggaaaaaataatagagtattttttgttttaaaggtatagttgttattttaaattaatttatttttgttattattttttttaggtattattttttatatttttttaaatggtattttgttaaggatttagttttttatttgatgtgtttataaaataattttttttataagttattagagttaaggttaaaagtaaatatatttatttatagagtaagatataattttgtagtgatatgagatgatttattttttttaattgtaaaaaaaaaattaattttgtaatttttaatatatttgttaatttattattagaaaatattttgagatttttgattaataaatttattattatagtttatatatttgtagtatattgttagatatagtgtttagttttttgtttgtattgtttaagttaatttttataataattttatgaaatagatgaggaagttaagattatatttagttaatgtgaggtagagttgggatttaaatttaggtgttttttatttaaaggttttgtttttaaattattttttgaagatagtgggtagtattgtggttttgggttattgattttttggtggaatgtttgtattattatttaaaagttatgtaatttgaggtatattatttaatttttgagttttatttttttttttttttagatagtttagtggttttttttttggagtgtagtggtataattatagtttattgtagttttgatttttaggttttaagttattttattgttttagttattttagtagtttggattataggggtttgttattatgtttagttattttgtgtgttttttggtagagattgggtttttttatgttgtttagttgattttgaatttttgggttgatgtaatttatttattttggttttttaaagtgttgggattataggtatgagttattgggtttggtttgagttttattttttttatttttaaatgggaattatttattttaagggatgatttttatgtttataaatatattaggaaagtagttagtattgtattgtatagtatttgtttaataaaatttatttattatgttattaaatgttttttaaaaatttaatatgtttataagaaaatatggttttttgtttattttgtaatggattatttatttagtaatatatttttaatttttataagtatagaagaaagattatataattttatgtaatttttaataattttttaaaagttattttatgtatttgatataaaattttatagaatttttttattgttttgttatttatttgttttattaaaattgaatatgtattaaattggatatttatattttttatttttataagaaaataaaaatattttttaaatgagggatgtttgttttgttgtgtattattataataattttttaagagatgttagtatatgttatgtgggataaaggttggtttttatttgatggaaaggttggtttttagttttattatgttgattgaaagatatgatattatttaatgttatatatgtttttatttgtttaattatttaatgttaagattttagtgtatatttgggtgtattttttggatttagatatgtgtattataaaatggatgtttttaaatgaaaaattagaagatgtatttgtaatttattttaatttatttaattttgattgtagaaaagagataataaaagtattttttgaaataatgtgttattgtaagatatgtttttatggttaatagttttgtaggtttagttggtgagtttatattttaaaatggtatatttaggtttgttttaatagttttttttattagttagattaagttagttaaagaaaggaaagagaaaaaagaataaaattaggaataatatttttatattatgtataaagttttgattttatgtttaatgaaggtttgttgtttttttatttagtatttttttttattttttttttttttttttttttttttatatatatttgataaaagagaagaatagaattaagaaaatattttatagttggtaaggtattatgtgatgttagttgttgttattaatatttaaatagataaatttttaaaagaagtaaagaggatagatttttaagttatttgaagatttgaattaaagatggtagtttttttatatgtaagtagtataatttgggtaagttaattagtgtatttgggatatatttgttttttttattaagagaggggataatgttaattttttatgatgttgatttgggtatttaattagatgaagtatatgaaaataatttttaagttttagatgtgtgtattattaagttgagattatttatttagtaaatttttatatttaatatattgaattaaaattagttgtatatatttattttttattattatgagaaaattatatttagtattggaatttgattttatttatattgttatttttagtgttttatataatataatgtttatagttggtatttaaaaatatttgtagaagataaaaaggagaaattaggagggtaagatgatgattggggttattggaagttaattgaggatgatgaaaaaaaaaggagtgattaaggtaataatagatttgtatattataatttagaagaatttattgttaaatatattgtgttttgatgattgaaaataagtttaatatatatatttgatgttattgtttatatattgatgaaagaagaaagtggttattttttaatttaatttaaataaatagtttgtaattggtttggattttttataagaattttattgtggataattataattttaatgtaaagaatttttttttgtttatttaaatattttttttaattgatttatttttagattattattttattgtgtaattaaaaatttattttgttttatttatttaaattttttgtttgaaaataaggtttataataataaataaatttataatttttatttgatgagatataattatttgtgattttttatttttttaagttataatgggaatattattttaatatggtggattatattaggggtgttagtaatttatttttttattagagtaagtgtttagaagagttgtaaagaattatttttattttaatattaaaatattatatagtttatttgatttttttgatagttttttagaattatatatttaagtgtttaaagtataataaaaaagaatgtatgtataaatatagaattaatgtaggtgttagattttagtttttttggttttttaaattagagtattatttatataattatgttgaattttttattaaaaaaattgtattaaattattatgaaattttaatgtaagttaaagtaaaaagttatatttatgattaattttttatttgtaaaaatgattgtataagttaaagttataattaataagaattaaagtagttaatatgtttttaattaagagtttatttttatatattttataatttttataatttaggatttgttataagttaatttgtatatttttaaataaaatattaaagtttaaagagatatttatatgtaaattatttaagtatttagatttgaaaggaaaattggtagtattaatttttttttatgggaaagaatagttatggtattggtttgattttttttaaaaaaaatttttagatttatgattgaaatatagaagtatttttataagtattataagggaattattattaaatagaaattaagataaaaggataagttaaagtagtttattatttttaattgtttatagtaaaattatatatgttattaataaatgattaataatttaataatttttttgaatagtttaaattttttttaatgatttattgtgtaaagaatgtttagtttgttttttgttaagtgtattggagtttaaatttaagtttttttgtatttagggtgatttatttttttgaaataaattatgttttggttaagtttttatttttgtagggttgagtgtaaatagagtatttaatttttttatttttagatttatgttaaatatgtaggttttgtgttaattttatttgtgaaaaattttttttaatatgttaaggttataattgaatatttaaagttaaatgagagaaattaaattaataatttaagtaagatataaaaatattttattaagagaagtagttattgtttttttgtgttttttttttttttttttttttttgagatagtattttgttttgttgtttaggttggagtgtagtggtaggattttggtttatagtaagttttgttttttaggtttatgttatttttttgttttagttttttaagtagttgggattataggtgtttattattatgtttagttagttttgtttttgtatttttagtagagatggggttttattgtgttagttagggtggttttgattttttgattttgtgatttgtttgttttagttttttaaagtgttagattatagatgtgagttattatgtttggtttattttgtgtttttgtttatgttttattttttatggattgagtttagtgaatgatttttgaagagtaaattagttttgaaaatatattataaagtgtttaaaagaaatatgataaaatggaaagagatatttaatttaatttaaatatattttatttttaggtttgttttaaataaaaaggttaatattgtttataatgaaaaatattttagtaaaatgttttaataaataatatttgttttaaggaaggtaatatttgatttaataaattgtagtataatattttagagttatttttgaaattatttgtttgtgattattatatttgtatttaaatatttttattgtttgattataggataatttattttttgtttttttatagtatgaaaagttttaattttagaatatgagttataggggtaaaagagtttttagaagttattttaatattttagtttttaatatatattatatttaaagtgttataaattattttttaattttgtgtagttagttttattttttaatagttatgtaattatagttgaatagtaaaataaaattttttaaattttatattattaataatttttttatggggaaataaaataattatatagttttattttttttaattttaagttaagaggtatatgtgtaggtttattatataatgtaaatttttgttatgggggttagttgtatagattattttgttaattaggtattaagtatagtatttattagttgttttttttgatttttttttaatttttattttttattttttaatatgttttagtatgtgttgtttttttttatgtgtttaggtgtttttattatttagtttttatttataagtgagagtatgtagtatttggttttttgtttttgtattaatttgttaaggataatgattttttgttttatttatgtttttgtaaagtatatggttttgtttttttttatggttgtatagtattttatggtgtatatgtattatattttttttatgtagtttattattgatgggtatttaggttgattttatgttattgttattgtgaatagtgttgtaatgaatatttatgtatgggtttttagaatagagtaatttgtatttttttgggtatatatttagtaattggattgttaggttgaatagtatttatgtttttaggttttttaggaattgatatattgttttttataatagtgtataagtgttttttttttttttataattttgttagtatttgttattttttgattttttaataatatttattttgattaatgtgagatagtattttattatggttttgatttgtttttttttaatgattattatgtggagttttttttatatgattgttggttatatgtgtgtttttttttgaaaagtgtttatttatgatttttgtttattttttaatggggttgtttttttttgtaaatttaaattttttatagttgttggatattaattagatttttgttagatgattagtttgtaaaattttttttttattttttaggttgtttgtttattttgttgtagttttttttgttgtgtagaagttttttagtttaattagatttaatttgttaatttttgttattgttataattgtttttggtatttttattatgaaatttttgtttatttttattttttgaaatttttgtttatttttatgttttgattggtattgtttaagttgttttttagggtttttatagtttgagattttatatttatgtttttaatttattttgagtttatttttatatatggtgtaaggaaggggtttaattttaattttttgtatatggtttgttagttattttaatattatttattgaatatggtgttttatttttattttttgtttttgttagtttttttaaaaattagatagttgtaagtgtgtgattttatttttgggttttttattttgttttattggtttatgtgtttgtttttatgtattagtattatgttttttttgattattgtagttttgtagaataaagttgggtagtgtgatgtttttagttttgttttttttatttagggtttgttttggttatttgggtttttattttattttatttttttggttttatgtgaattttaaaagagttttttttagttttgtgaagaattttaatggtaatttaataggaatagtattgaatttataaattgttttgggtagtatggttatttttatagtattgatgttttttatttatgagtatggaatgtttttttatttgtttgtattatttttgatttgtttgagtagtggtttgtagttttttttgtagagatatttatttttttagttgtttgtatttttaggtattttattttttttgtggaaattataaattggattgtattttttatttggtttttggtatgattgttgttggtgtataggaatgttagagatttttttatattgattttgtattttgagattttgttgaagttgtttattagtttaagaagtttttgggttgagattatagggtttttttttttttttttttttttttgagatggagttttgttttgttgtttaggttggagtgtagtggtgtaatttttgtttattgtaatttttgttttttggtttaatgttatttttttgttttggttttttgagtagttgggattataggtgtttattattatgtttggttaattttttgtatttttagtagagatggggttttattatgttagttagtgtggttttgattttttgattttgtgatttgtttgttttggttttttaaagtgttgggattataggtatgagttgttgtatttggttatgggttttttatatataggattatgttatttgtaaattgatatggtttgatattttttttttttatgtgtatgttttttattttttttgtttgattgttttggttaggatttttaatattgtgttgattaggagaagtgagagatggtattttggttttgtgttagtttttaaggtgaatgattttagtttttgtttatttagtatgatgttggttttgggtttgttatagatagttgttattattttgaggtatgtttttttaatatttagtatattgatagtttttatatgatggggtgttgaattttattaaaagttttttttgtatttattgatttaattatgtggtttttgtttttaattttgtttatgtgatgaattatatttattgatttgtatatgttaaataagttttgttttttagagataaagtttatttgattgttatggatgagttttttgatgtgttgttggatttggtttgttagttatttttttttgaggatttttttgttgatgtttattaaggatattggtttgaaggttttttttttgttgtatttttgtttggttttggtattaggatgatgttagttttatagaatgagttaaggtggagttttttttttttaattttttggaatagttttagtaggaatggtattagtttttttttgtatatttggtagaatttagttgtgaatttatttggttttgggtttttttttttttggttagttggttatttattattaatttaattttagagtttattattggtttgtttagggatttaattttttttttgtttagttttgggagagggtatgtatttaggaatttatttatttttttaagattttttagtttatgtgtatagaggtgtttataatattttttggtggttttttatatttttgtggggtaagtggtaatatttttttttgttatttttgattgtgtttatttgaatttttttttttttttttattagtttagttagtagtttattttatttttttttaaagtattagtttttagatttgttaattttttgaatgaaattttgtgttttaaatttttttagttgagttgtgattttggttattttttgttttttgttagttttaggatttgtttgttttttgttttttagtttttttagttgtgattttaggtttttaatttgagatttttttaattttttgattgggtatttagtgttatgaattttttttttaatattgtattagttgtgttttagagattttggtatgttgtatttttgtttttattaattttaaatatttttttgatttttgttttaattttattatttatttaaatattatttaggagtagttatttaatttttatgtgattgtatggtgttgagtgaattttatttttgatttttaatttgattttgttgtggtttaagagattgttttttattattttattttttttgtattttttgaggagtgttttatttttaattatgtgtttaatttttgagtatgtgttatgtggtaatgagaagaatatatattttgttattttggggtggagagttttgtaggtatttattaggtttatttgatttaatgttgagtttaggttttgattatttttgttaattttttattttgatgatttgtttaatattgttagtgaggtgttaaagatttattattatgtgggagtttgagtttttttaaagttttttaagaatttgttttatgaatttgggtgtttttgttttaggtgtatatatatttattatagttagatttttttgttgaattgaattttttattattatgtaatttttttgattttttttatttttattggttaaaagtttgttttgttagaaattaggattgtaaattttattttttattgttttttatttgtttggtggatttttttttattattttattttgaggttatgagtgttattgtatgtgagatggattttttgaagataatatattaatgggttttggttttttatttagtttgttattttgtgtgttttaattggggtatttagttatttatatttaaggtaattgttgatatgtgtggattttatattgttattatgatgttagttggttattttgtagatttgtttatgtggttgttttatagtgttattggtttgtgtaatttagtgtgtttttgtggtgtttggtgttggttttttttttttatatttagtgatttttttaggagttttggtaaggtaggtttggtggtaataaatttttttagtgtttgtttatttgaaaaggattttatttttttttggtttatgaagtttagtttggttagatatagaattttggtttggaattttttttttgtaagaatgttgaatattggttttaaattttttttggtttgtagggtttttgttgaaaggtttatttttagtttgattggttttttttgtagttgatttgatttttttttttagttgtttttagtatttttttttttattttaatttttaaaaatatgatgattatgtgttttggggatgatttttttgtgaagtattttattgtggttttttgtattttttgagtttgaatattggttttattagttaggttggggaagtttttttggatgatattttgaaatatggtttttaagttagttttattttttttatttttttttttagggatattaatgagttgtagatttagttatatattttttgaattttttttatttttttttatttttttttttttatttttgtttgattgttttattttagaaagttagtttttaagttttgagattattttttttgtttggtttattttgttgttgatatttgtgattgtattatgaaatttttgtagtgtgttttttagttttattaggttggttatatttttttttaaattgtttattttttttgttagtttttttattgttttataattatttttagtttttttattttgggttatagtatattgttttagtttagtaatttttatttttgtggataatttgaattttatttttgtgaatttagttatttgagtttagtttagaatttttgttggagaggtgattttattatttggaggaaataaggtattttggtttttttaattttaagtttttttagaggatttttttttatttttgtgggtttatttatttttaagttttgaaattgataatttttgatttttttttttttttattttatttgatgattttgagggtttgattgtggtataaggtagatttagtagattagtttttgtaagattttatggggttaatatttattttttaatttttggattgtatgttataattttgggggatttatattaggttttgattttgttttttggttttttaaggtttggaatttattgtattggaagggagggttaaggtgtagtagttgtagtagagtgttaataagtgttggggtatttgtttttttgtaggtgtttattatagtggtagaggtaatatagttggtaggtaggagtagaggatttttgttggagattgtgtgtgggtatgttggaggtggtattagtttaggggttgggtattggtgggaaaagtttggatgttttttttgtgttttttaagtaggtgtgatttattatatagttttgtatatagttttatttgtttttgtgtaattaatgtatatattttattaaagaatttatatagttaatattagaagtttttatgtaggtatttttgaattataattattaggagttataatttagtaaaaggatattttgtttttagtattttaaggaagatgtggttattttaaaatgggagggtatttggggattaatattttatttttttgaaatgttaatagatttgaggatggtatgttagattgagttaaagtatttgtatgggaaaaggtatgttttttatagaaatatggattttatttagatggttgggtagttgggtggtgtttagattgtaggaataaataatgaatattttgtttatttgtataaggttagttaggtgttaagtatataaatttaataaggtatagtgtttatttgaaggagtttgaaggagagagaaaaatttggagagaattaatgaagaggttattggatttggtagttaaaagtagttttgtgtggttttttttttttttttttttttttttttttttgagatggagttttgttttgttgtttaggttggagtgtagtggtgggattttggtttattgtaagttttgttttttgggtttatgttatttttttgttttagttttttaagtagttgggattataggtgtttgttattatgtttggttaatttttttgtatttttagtagagatggggttttattgttttagttgggatggttttgattttttgattttgtgatttgtttgttttggttttttaaagtgttgggattataggtgtgagttattgtgtttggttagttttgtgtgtttttaaagagaaattttagttatttaaagaaatggatatgaagtagttatattatttggggtatatattttggggtttgttattttgtattaggaaaatttaggatatggatttatatgaggagtttagtagtagaggtttaataggtagaagagaagtgaaagagaaatagttttttttttatagagagaggggttttttagtggaaaagattggttgttagtgaatgtgttaaattttatagttaggtttgaggaggtggtgtttgatttatatagggtttatagattggtttgattaggtatgatgtttatataatgtatgtggaaggtggttgttttattttaatgttagtatgtaaatgggttttttagttgattggtgttattttttttgttttttattgtatatttggttgataaagggaagagaagatggattattttgaatatgtatagtttttattttttgttagtatttatttatgtaagtttttagtttgtttgtttatgtttgtagtttaattttataggttgttttttgttagaaaatgatttgtggttgttttttaataaaaagtaaagttttattaaggatttttatttagttattttttgtttaagtgattttttaatttttatattgtttttttttttggagtggtaattttaattgttgttagtggttatttgaatgatgattttttttggtaatttttttttataaaggggtattgtgtggggaatagtagttatggttttttttggggttaatttaagggtttttggaagaaaggtatgtttatgtatggttttgtttgtagtattatttggagtttgattgtttttaaatgagaagagatgaatgttagtttgaatatgattattaagattgttattattagtggaggtattataggttataattataatagtagggtttgttatttgttagttattttgatgaaatgaaatattggtttgtttttattaaatgttgttgtattttattagaagtgttgatataaaagtaatatttttttttttttgagaaaaatatatatatttttgttgttttgttattaggggataatttttggtttaggttattttttttaatttgtaatatgattgggagaaatatgttattgggtggttagtgtaattttagtgttaattttagttaaattttttttgtaattaatttttttatagtttttattaattatttatgatatgtttaaattttttggtttgttttaaatatttttttttttaaataattaattattttttttaggatatgtatttattatttttttaatttttttatgatttttatgaattatttatgatatgtttaaattttttgatttgttttaaatattttttttttaaataattagttattttttttaggataagtattttttatataagatttttttttatataaaattttttttttttataattttttttgtattaaatggtagtatgagtatggagaattaaaaaagtatatttggagttagtgtaaatgttagttatttttattttgtttaatttaagtgtttttgtaagagttattagtttagttggttgagtatttatgtttggagtgagagatatatttttaataatatttagagtgattattgtatattttgttttttgtattttttgttttgtaaaggagtttttgtttatgaagagggtttaatttggattttttaggggagtttttttgagattttttttggttgtataggtttgtattataatttgtttatagttatatttaggttttttagtttttttggggagaaaggtgattgggtttaagtaaaaataagtttttaattggatggtggaattttttgatagtagggtttgatatttaaggagtttgttgtttgttaattaaaggttttttttagaggatagtaattttattatattatatggggtataaatagttatgttattttttaggattaatttggaggtttttgggattagtagagttattgtagtaatggattaggggtatgttggtaattttttaattattaaattaagttttttatttaggtaatttattggttgttgagttggtttatagatttgtgttaaaatttttaaggttattttttttttttttgatatatatagattgaaggttttttttatggaaaggttgtgattatggttttagtgagatggaagttttgaagtagtttttattttttattgagttttatgtgtttttaatattggggtgttgaatgggttgttttaggttttgaagaggttttgtattattaggttattagtaatggtttttagtttttttttagtttttggttttagtggatattgtttttggttaggaaaagaagtgggatttttaagatggatttggattggtttagtagttatagtttaatttattgtttttttagttgtttatatttttggattgatattagtttttattagggggtgatagagtttgttttggggttataaggatgttggtttgtttgtaagtaaaatatttttatttaataaaggagtggaattttttggtatgattaaaaaagtatgtgttaataataggtttttttatttgtaatttaaggggttgtgaaaaatattgaattagatttttttttgagatgttttgtgatgtttggttatgttatagaaagaggggaggtttggattagagaggagaagagagagagagattggttttagtgtttataaggagatttatttttttttaatttttagaattatttagggtttttgtgttgtatgttggtttgagttattggagttttgggatttattaattttgttggataatttgtgagattggtttggaatttggtgatttttatttttgggggtagtttgatttttaatggttttttttataggttagataaggttaaggtggtttttttttgttgtttgggtatttttttttaaagtgttttgatttgttgtatttatagaaattagtagatgtattttagggattttgggttttgtatgtttgtagagtagttattagtgtttttgttttttttttttgtttttttttttttttttggattttttttttttggtttttattataaaatattaaagtggttatttttaggaggttttttaagatgttatttggtgttatagtttttttttgtattttttttttaatattgggaggtgtttttttaataaatttgttttttaggatgagttgtttttgattgatttaggggataaaggtatgttttatgagtgtttattagtttttttataaaggttgtaggatttttatttggttttgttttattttggaaagtatagagtaattaatagattttgtttttgttttttataggttttttaatatgtgtattaaatggtgtttttttttttatttatttgtggtattattggtgttttaattagggtttgtttttttttttagaggaattgtttttttttttattgggaatggtgtttttattatttttttgttttttttatttttttttttttttttaatttattataggagatatgttgtttattgttagaattttttgttgtttgtagaattgtttgtttttttattgtggttaggatttggtttaagagtagtaaaatatttttttgtgtgtggtgaaatatttgagttaaattttggaagggttttatatatttattaggattattagaaaattggtttaaatttttttttatttgtttaagattttgtaatgagatgggaatttgaggtgattttaaataatggggatttttagatggtttttttggaagttgtttttttagttttagggaattattttttttgggtttgtttgatatgattgttatatttgtaaaggtttagtaagaaggttatgtttttgtgtaaaagaaaatgagttattttttttttaaagttttaggattaaaggagtttttgtgttttagaatgtattttagaggagtataggttttagatgataaagagaaggaaaaaaaggtatttttttagtttttttttttttgatgtgatttagggtgggagaaagatagtgggggtgtttttttgttgttttttttttatggtttttggtattttggtattttgttaaatgtgttgtttatggttgtaggtgtggtttttttagttatggaattagaggaattaagtggtgggttttagttatttttatttatgtaattttagttttttgtttagattttggggttttttgaaaaatggattttgggaaagattatgtaatagttgtatttgggtaattgttgtatttgtttttttaatggaggaagtgtgttggtttgagttttatattttgttattatggtttatgttaaagtgtttatttttagagaattattttagttaatttttgatttaaaatttttttattaattaagtattattttaattggaggtagaataggtattttaaaagaatgtagggattaaatggttatttttttgaaggaaggatagtattaagattaaaatttggttttggaggatattttatttttaattgttgaaggtagagtttttttatttatagaaatagtataaagtttggtttttagtagagaggtgtaaaaaggggagagaattgggaagttagagtgtttgggtaaaggagaggatttttattttattaggtggtgttgttgattttgagatgttatgtgttttttagattaagggtagagtgattttgatatgttatgtgttttttagattaagggtagagagagagagatttggaaatgttatgtgttttttagaataagggtagggagagatgtttattgggggtattttttgtttttagaatattataaaaatatttttttttgagttatatgtttatttattatgatattatttgattttgttaaataggattttttttttgaattataaatttttttatatattgtatatatagagaggataagagttatgatagttgttaataggaaagaaagaaattatgataggaaagttggagattttgtggttgatagtttattagtggggatagaggttggggttagtttagtagtttttggataatattagggatagttttagttagaaatttttagttgttttaggattttttttagttttatatgatggttgagtattttatgaaaggaagttggtttaaatatggttaatatgttaagtaatttatgggttttttatgttttttttagtaagtttgttttttaagttttatatggttggtagttatgttaattattttatggttgaagggggtttagtatttggtttgatttggtttttaaatggaggttaatagtttttgaatgaaaggatagagttggagtttgtttttttatttattgttttaattaatgttgtatgttggtattatggatgaggtttttagtatgaaatggttatgttgtttggggtatatattttgggatttattattttatattaggaaaatttaggatatggatatatataaggagtttaggagtggagatttaataggtagaagagaagtgaaagagaaatagttttttttttgtagagggagaggggtttttgagtagaaaagattggttggtgttgaatgtgttggattttatagttaggtttgaggaggtggtgtttgatttatatagggtttatagattggtttgattaggtatgatgtttatatagtgtgtggggaaggttggttattgtattttaattttattatgtaaataggttttttagttgattagtgatattttgtttgttttttattgtatatgtggttgagaaagaaaagggaagatggagttgttattttgaatatgtgtagtttatagtttttgttggtatttatttgtttaagtttttagtttgtttgtttatgtttgtagtttgattttataggttgtttttttttagaaaatgatttggggttgttttttattaaaaagtaaagttttattaaggatttttatatttttattttttgttttagtgatttttttttaatttttatattggatatattgtgggttgttaaaaagtgattatggagtgaagtataaaaaaaaaaatagttatatattagtttttttatgtagtatagtggtagaaaaggatgtgatggtttagggattaagaagaaagtagtatgatagaaagatttttaagattagagattataaagggtttttttagtagggaaattgatattataagatgatataagagaatgggggagagagtattttggagttattgatggtgtagttttagaaaaaattggggaattgaaagtgagagtataagagatgatattagatttataatatttttagatatttggggaaatattatttaatataaatgtatggttttttaatatttatttgtagaatgaagtatgaaattaatataatattaagttgttagaagtttataggttttaaaagtaaaagtggtaaaatttttttttaatagtttatgtaattttttaaaattatattaattgaaaggataggaaatgggtatattttttatggtattaaattaatttttattttggtagaaaaattgattattatagttattgtgagttattgttattataattgagtggattatttgtttagtatgttttttttagtaaaagaaaaatatttgtggtttttgtggtgaataagaattttaatattaggaaaaaaatgtaggttttttttttgttgttgttttgtatatatttgtttgtttgttttagtattaaatgtggtttttttagatgtaggaggtggaggtggaagaaatagagagttgattataatatgggtggtaagtattgatgagttgtatatattataggttgttgtatttatatttaatttttattttattttgttttttgaaataaattgagatgaaagtgattgtttattgtataagtaagaatatattattattttttttttttaaatgtaaattagattttatttggtttattgtggtttagtgtgtagtttttatgtaagaatgaattttggatgttaagagatttgttagtttagatgattaaatatttagttgtttgattttagagatattttgattattgtagtttggtaatttaattgtaattttaaatattgtttttggatattttaaattttaaagattttatttataaattttgtattaaaatttatttttaaattggagattgtttttttatttgaagtttattttgattattggtgtaatttagtatgataggttagttttagaagttatttatgggattagttattgaggtatttaaagtattttattatagttttgtgagttaaagagttttgtattagagattataatttttagaaaataatatattttggttggatttttgaaataggaaagatattgggaggggtgggaaaagttgtttgataaaattgtttgatttagatatttggtatttatttagataatatggtttatatagatttatttatttattaaatatatttagtgttgaattattgtagatagttaaagagtataatttaggttttaaaggattttgaagattgtggaaaaaatgataggttttattttttgtattggttaaatggatttatttaataaatgaatgtttagtaaaatttgatttattgtgtgttttgtagttattttttatatttagtatttaaattatattttaaagtaagatttagtaaaaaaaaattaatttgaattgtaaaatatttatttttaagtttaattgttaatgaaatgtttaaaaatgtaaatattataaaaattagaatattttgtttttttttttatggttttttataaattttgtggatatttgttatagaataagatgggttttataaaaaatttagtattggaaatttttttttaaagatttaaatttaggtttttggagatagagtttgagagttgttatttttgaaatttttatagttgattttgttatattttaaattttaaaaattaagtagagaattattaataagaaaaatgtttaaattattgtagaaatgttaggttatattatttaataatttaaaattatatatttattaatatattgtgtaattatatatagtttttattatttgatttttttatatttttatatttttttatttaatataagtatgtttaagtaatagtgttatatttattttaaggttttgttttaagatattttaaatttgattttttggtaaaaaaaaaaaaaagtaaatatataatgtgtatatttatttaaattgttaaaaaaggttaattgataagtatttattagaagtagttgtaagttagtttttattaataataggtgattagggttgatatagatttttttataaggtaatttatatgagtgataagaaattttgagaaaatgatgaaaaattaagtatttgttttagaattggagatagaaatttaaagttatttttttataaatgagtgtaatattgtttttttttttttgttatttatttttattttttttattagtttttttttgattataaggtagatattttaggttagagttttatataatttttttattattgttttttaattttaatgaaatttatttgtttatttttttaatatatattatttgaagttttgttttaggtgttagggataaagaggaaaataaaattgataaaaatgttgtatttataaaatgtgtattttagtagttgagagagataataaagtagataaataagtaaattgtatagattttgttagggttaaagaaaaataataggtagggtgtgggatatggagtattgtgttggagttttgtagtggtagaatttgtggttggagaaaatgttgaggtgattttattttgggaaagtgagggggtgggaggagttatataatatttaggagaatattttaggtagaagaaattgaaaggaaaaaggtttggagtgagaggtttttgaggtgttttaggagtagtgaggttataatttggtaaataagattattttatgtttaagtatgttttttttttgatatttggaattagtattaatgtatgaattgtgtatgtttttataaagagtatgtttttgtgtgtgttattatttttatagtattttttttttgttatttgtattattaaaatttatttaattttttaatttttatttagtttttgttaagagaatattattatggtaataattttggttatatagtggtatttaagttatttgatggagaagaatggaaaaaagttatagttattaattttgatattggttgatatgtttataaagatgaaattatgagtttttttattgtattttaagttaaagttaaggtttttaataataaaggagatggattttatagtttagtagtagttattaatttagtataagatggtaggtgaaagaaagatttttttatttgaggagggaggaaaaatgtatttttttagtaggtatttagtttgtttttttttaggttttatttattaagatttttttatagtattatgtatttagtaaatgagtattattttgaattaaattaaatattattttttttatttaaatgatgagaatgttgttagagttttttttattatttagattatgtttatggtatgaggaaatttttattaaaataattggttttgatttttatttttgggtttttgattataattttgtagttagaaattttttatatttgaatagaattttaatatgtttgtatatttataaagtttataatttaaaatttttataatatggttgggtgtggtggtgtatgtttgtaattttagtattttgggaggtggaggtaggtagatttgtttggaggatagagtaagattttgttttaaaaaaaaaaaaaaaaaaatttttgtaatgtatatattatatatattatttgtaaaatggttttaaattttaatttaaaaatgtgtttaattgtagtatttatgtaattttttattataatatagaatataaattttgttaaagggaatttagatataattatatgaaaaagaggttagttgaaattgtttttttgaaaagggaaaaatttgttttgtagggtatttaggaaaaaaataatgttaatattagttttttttgtttttttagaaattttaatttaattaattatggttatagaagattttatatatttatataaatgatatatagttttagattgagtataattatattattttttttgatttttgtttaagttgttatatttttgttatttatatttttgttaaaaataatatttttttggtttggtatggtggtttatgtttgtaattttagtatttagggaggttgaggtaggtggattatttgaggttgggagtttgagattagtgtgattaatatggagaaattttgtttttattaaaattataaaatgagttaggattggtggtatatgtttgtaatgttagttatttgggaggttgaggtaggagaattgtttggatttgggaggtgaagttgttgtgagttgagattaggttattgtattttagtttgggtaataaaagtgaaagtttattttaaaaaaaaaaaataataataataataatagttttttttatttatgtgtattgtgtaaataattaatgattagaaaaataaatagagatgttattgttttttgatttttggtaatgtatatttatttttggttaagtttttttttgtatatgtgtgagaagtataaatagaagagtttgaaaattaaaggtgtgtgaggtatttttttattattagaggaaatgggttttattggtttatttaatttttattgtttttattttaagatagatatttagttatgttttatattttaatagaaatttttatgtatatttattggttatagaattattagttttagtatttgttaaaaatgtaatatataattaaattattttatgatttttatttttattaaatattattgtattttatatatgtatgttataatattatgttatatgttttaaatatatataataaaatttaatataaaaggtagttatttatatatgttaaagtatatatgtgtgtatatataagtatatatgtatatatttaaagttatatatatattttttattatattttttattgtatataaaagtatgtgtattttaatatatgtgtgtgtgtgtgtgtatgtgtatgtgtgtatttttttatttttaagttagtataattaaatatgttaaaagaataaaatgtagaaataatttgtttattattaaatagtggaaaagttttgatgataaatttatattttttatgtttgtgtttatttagtagaaatatgataatttggttgagtgtggtggtttatgtttataattttagtattttgggaggttgaggtgggtggattatttgaagttaggagtttgagattagtttgattaatatggagaaattttatttttattaaaaatataaaattagttaggtgttgtggtataagtttgtaattttagttatttaggaggttgaggtaggagaattatttgaatttgggaggtggaggttgtggtgaattgagattgtgttattgtattttagtttgggtaataagagtgaaattttattttaaaaataaaataaaataataatgaaatatgataattttatttagttttaataatttgaagaatgagtatattttatagataaaatgagtgttttaagtattttataagttatttttttatttttttattgttttatttgatgttaaaataagtttttaggtaaatagtttgttatttatttagttatggttatttgtatttaattatattttttttttaaatattttatgagttttataaaatttgtatgtgttgaaatttgtataagtgttaatttttttttttattgttgagaaattaattatagtgttatatatttgttttgttttagaaagttaatagtgtttatgtgtagaatatttttaaatattaaataggattatggtattttaatgaaagataataaaaattgattatttttgtttaaagtttttattggtttttttgtgtaaattttataagggatgttagttattttttttttgtgaatagagatttttttgatatatatttgatttgatgtttagttggaagattagatatataaaagtttttttgagtttaggaaatagtggatgttataatttgttttaaaggtttttaaaaatttttttttaaagattttagtttgaatataaaaagggaagttttattaataatattgttgtttgtagttagtttatataaatagtaaataagagaaaatgtattatattgaataattttttataattttaaattttttatttttgataatatagagttgatagttaaatattaataattttaatttgtattaataggtttttttaagtatattagttgagagaaattaaaaaaatagtttttttttgtttatagatgtaatagaaattgatgaagttttttgtatttggtaaaagtgtgtgtgggaatgtgtatgtgtatatgtttatattaatatttatgtaaatgaatgtgtgtgtgtatatgtattattaatgttataaaataaagtaatattagaaaaatataggaagaggtaatgaaataattgtatttagtttgaaaatagtaaagttattttagaaatattaaaattaaagtatggtttaatattatttatatagtaaatgatgttatttgaattttttaaatgtaaatattttattaataatataatgtttttataaaattttagtttttagtgaagttttaatagaagtaggtgtaaaagttttattattttttgagatatttgtttattgggaatatgttttagaaaaaatagtggaaagttattaggtatgttaaatttttattaaattaaatatatttatttataaatatataagtatatgtttttaaatgtgttgtatgttttaatgttttattaatttatgtggtaattaatattttattttttgtgtttagtattgtggttatatataagttaattgttaagaataaaataggggtttttaattggtttatttaggggagatgtaaagaaatttaagttttggtaaataattggttaaaataaaaattatggtaataatatttatgattatttaaggtttttttaggaaaatatttttataaaaagttagtgaattttaagttttttggaaagtattttggtaatttatagaagtattttgaaaatagttattttttttgagttagtagttttattttgaaaagtttttttaaagtaaataattttaaatatattgaatatgttttatgttatttatgaagtaataattaaaatgatttaaataaaattttttttgagtttaattttaaagaattagtaagaattagttagatgtaaatgagaaaatttgttttagttaagggagtaaaaattggaaaattaaaattagagagattagttagggtttttaatataatgttaatgtaatttagattgagttatgtaggaaatgtgaaattattattttatatttttaagtgtaagaagtgaaaatttaaaggaattaatatggttttttttttatagatgagtaaatggatattaaagagatttgataatttgtttgagttgttatttatagaaagtgttagagtagtgtttaaaatttaagttgtttgatttaaagtttggggttttattgttatatattatagatttttttgtttttttttttagtgagtgttgtttagggttgtttttttatttattttatttttttagttagtttgtatttttagttttagtatttttttttattttttgtttatggaatattagttttatgagggtagggtattgttttatttttagtgttatgtaagattagtgttgagtatttggtaggttttaaatagatattaattgaatattgataggaataatgaagtatgattaaataaaatgttataattgggtttttttaaggttatgtttttgagatgtagttgtaaaagaaatttaaggttttgagtagatatatttagattaataggaagttttttttttttttttttgatataataggttataatttgggaagattttaaagagtttttagattatttatgtaagggtttagttgaatttattatagtatatagaagagtagattgggaataattagattgagaatatttaatatttataatttattaatttgataattgtgtttgtggttagtaggaaagagagaaatttattagatgttataaatttttgtaataaatatgtttgaggtatttttgggagaagatattaatgtgtagagtttggaaagtaaaattttggagtataggatttttttttttttttatattatttatttttaattaataaatattgaaaaaaggataatttaatatataatttatattattgagttaaaatgttaaatatatgatatattttattttatttaaaatatgttagaaaattatatattatttttgttaatgttaagaattatatattgatgatttgtttatttttaataagaagaagataaaagaaataagaggtaggaagtaatatagtggaattaatgatttagatgataattaaattaaatatgtttttttaattgggaattaaattttgattaaggatttttatatagttagtaaaaagtaatttttattaaagaagattttttttaaatgataattttaagggaaaagtatgtattatgaggagttggttttatagatgtttgattttttttaatttatattaagtaaaaatttatgtattttgttgttgagtaaatatgggtttatattttagttttgttatttaagaattttgtagaaaattgatttgaattttgagtttttttatttataaagtgagaaagtaattattgttttatagaattgttatgtgaaagatattaaataatttgtatttaagaattttttttgtttatgttattgggtattttaagatggtggtgatgatgatgatgttgatggtagtgaggaagatgatgatgatgttaatgatgaaaagattgataatatgttttgagtttttattgtgttaaatatttaattaagtttattttattaaatttatataattttagaggatagatattattattatttttattttagagatgaagaatttgaggattagaaatgtttgtttgagtaataattgttataattagattttaatttagtttttgtttttttagagaatggttgattaaaattgttggaagtaaattatagaattattttttttatttatttttttttaaaatttttttaaattttttatatagggttttggatattaaagagataagtatgaatatttaaaagagaaaaatttatattatttattgttttgtaggaaatgtttttgtgattgtggttggtaggggggaggggggttttgattgattataatgtggttattgtttttattttaaaatatgatgggagaagttaatggtttaataagatagatgatggtgaaaattaatattttaatgtattttttatgaaaatgtatgatggatttttatttttttgtgtataaagatatatagaaagaaagtagtatattgaaaatataaaatataaagttggaaagttttgatttttgtttgattgatattattttaaggtttattttttgatattttaaatgagaattgtgagtaattgaatttaaagataatttttttttttgtggttttaaagtgtattttagtagaatgtttatgttatttagtatttttttattttatttggttaaagagttttttatttttaattttaatatttagggagtttttttatagtgtaggtaagttagaagaatataagaagttttttttattaagggtattttggaattttgggtttttgtttaggaatttataaaagatttagtttgtttatatagtgggtaaaatatttatttaattaatttaataaaaatgagtaaaataggttattaggaataatgaatgtaaaaattttagtatttaaattagagattaatgtagatgattgattttagttattataaaagatgaataattttgtatagtttatttaaatatttttaaagtttaaattattatggtgagttgaaattgattatttagaaagtgttttatttttttattttggagaagatatttgttttggtttgaatttttttgaaatagagttttaaataaagatgtggagaaaggttgtttattattgttgttaattgtttgtttttaatatgattttaggaagtaggtatgaggaaaaggtagagtgaataggaaagaggggagtttagatataaatgtgttatttgttttgttggtaattattgtgggtaattggtattttattttttgagatttttgaggagttttataaatgtgtttttgaagttgttttgtttgggatgaaaagggaagtatttatttatttttgaatgtttagaaatgtgtttatttaatatataaattttatttttgtgaagtgaatttgagttattttgttgtattttataatagttttttatatgtttatgtaaataaaaaatgtaggattatattattattagatattttaatttaggtattttggttaattgtgaaattataattttgttattttatagatagggtatttaaaatatgtaaaatattaggatagttataaataatttttttttttttatttttatattatatataatatatttttatttattttatttatattttagatataattataaattttgaatgtaaaaaagtttttatttaaagatgaaaattataatttataattttttttaaattttaagagaaaagtaattttgtaattatttgataaaagtaattatttttaatgaaaaaattgataatttttttaaaaattattttatgggtaaataatttttatagtttatttagttattagatatatttttttgatatttagtttttatatgggtttaaaggaaataatattagatatttttgaaaggaggtagaagaaagtattattttagtgtattttaggttatatagtaattatttttatttagtaaaattatatttttttttaattgttttaagaatggtttagaagaagtttgaaattatgtaaatagaagtaaaataggaaataaatgataaaaattatagtgataaatatttttaaatggagattatttttatattttgaaagtaagtttgttttaaagtttttgggatttttaaattttttattttttattttttttagttaatgtaaaataattttgggtaatgaagtaagattttgatttgtttttggtatttttagttatttttgttttgtatgttttattatattttaaggttgataaaagggtagatattattaagaaatatttgaaaatatgatgattagttaatattaatggtaatagaattagttgaagagaattttttatagttgaagattttaaattatggtaaaatataatttattttgaatgtttgtagatttggtattgggttgtttatgataaagaagaagttgtaaatagagtttaagttattagttaagagtatttggttaggtttgagaattttttgttagatatttagtattttatagaagttggggtttgtaatagtgtagggtgtggatttttaagtgatatgattgaggtttttattaagaaagtatgtgagttttatgttttgtttttagatttgttaaaaattattattggatttaattatgatatgaatatatttgaaggaaattttttatttagttatttgagtatattttttaatattttttatagttatataagattttttttaaaatgtgaattattgtagatgatgaaaaaatgtgaaaaatatttttatatgttaaatattttattatagaaataaagttagagaattatttttttgtaaaggttgtttttttaaattttgtgttattaatttgtttttattttgtatttattaatttaaatattgtttttataggagtatattaatagtatgtgaaaattaaaattttgtttatttttatatgttttaatttataaatttttgttattgtatagtgtaatgtaagttaagtgtgtagtattatgtttatttttttattattgtatgttttagtattgtatgttttaggtggtttataaaataagattgtttatttttgtttatgttttggttattttaatttttttgggtttattttgatatttttgtttttgaatttaagtggaataagtaaaaaggagaatttttatgtaggattttagggaatgttttaagaatttgaagatgtgattattattagagtgtgaaaatttatgaaatttattttgggatagagatttttttagtgagatgatagaatgtagtgataagaattagaatttggtgtttaatatgtgtttgagatttgtttttgttatttgttagatgtatgataatagataaattatttatttaaattttagttttttaatttgtaaaaggagtatttatttttgttttttttttatttgtttatgtatttatttatttattaaaaatatgttgtgtgtttagtattatttttgatggtgaggatataaaagggattaaattagtttaaggtgttatttttgtatggtttataagttaatgaaatgagatagaaattttaaataaatataaattttgataaataaataagtgggattaaagtagttgatagggtaataaaatgaataaatagataaaagtaaagtgatttagataaaagtgaaattttgattgggtggttaggaaaggtttttgagaagatgttagttaagttatgatttgagtgataaatgataagaagaatttattatgtgaatagttttaggtagagttttaaggttttttgtattttaagtagtataaaattttaaggtgaagagtatttaaaatattttaggtgtggaaaggttattgggtttagggtataggttttgagtaaggagggggaagtgttttggggtttaattatggagaattttgtaagtaattgtgatgagtttgagttttttttaaatatgataagaagttattgaaagattttaaaatagagagtgatatttaatttatgatgttgtttttaaaaaagttattttggtatttgtatagaaaatggattgtggtgggttaatagtggaagtagaaaagttagttaggagattattttagtagttaaggagagaattgatagtggttagtattaagtgaaaatggagatagaagtggaaagttttttgtaggtagagttgataatttgttgttaatttggatgttggtaatgagtgggatgagagattaaatattaaatttttgtttgagaaattagggggttggttgtgttatttgttgatgatggtaaagagttattggagaaagatttgaggatatttgatattatattatatttgaaaaatgtattatatttgattatattatatttgagaaattttttagagatttaagtagaaataggttgatatttgtttagatagagagatttatagttatatatgtttagaggttgaaagagagattagggttagagatagaattgtgaatatttaaagttatgggtttaagtgttagtatttagggaagatttatagagagagtagaaaaggtatatagatgaagttttaaattatttaatagttataagttgatagagggagttagttaagtatgaataatgggaagtagtagtttatgaggtagaaggaaaatttagttgttaagatttgaatttaagaaaaaatgagagatttaagaaagaagatggttaattttgtgaaatgttttaaaaatgttaaatttaaaaaagaataattaagtgatattagatttaattaagtggaggtgattgatgattttgtaaatagtaattttaaaagattagtggagaaagaaatttaagtggagtatgatgagaagagaataaaagttatattatttagtttatagggttatggggtatattaaatggatttatggatgtaaagtgtttagtatagtgtttggtatatagtaaatatttattaaaattagatggtggtggttattattattagtattataatatttgatgtaatagagtatgtagaattgagattggatatagtgattattgattgtatattattattttttatagtttttagttagtttttaaggattattagtttagtaaggtttggtttatgttatataattatttgggattatgttgttgtattattaaatgaatttatagtgatgggatataaggtatatataaatagtgatgattaatgtttgtaatttttgttattttagtgaaatttaagatgggttttttttttttttttgagatggaattttgttttgttatttagattggagtgtagtggtataattttggtttattgtagtttttattttttgggtttaagtgatttttttgttttagttttttaagtagttgggattataggtgtttatatttatatttggttaatttttgtatttttagtagagatagggttttattgttttggttagggtggttttgaatttttgattttaaattatttatttattttaattttttaaagtgttgggattataggtatgagttattatggttggttttatttaatttttttattttatttaatagttgtagagtagaattagataatgtagtgttatgatatattttgaaatggaaaatattatttttagtgaattttagtaaaatgttatgttaaaagtgtaagataagtagaatattttaaagataaaatagaataattagagtttaaggaggagagagaatgaaattatttttgtttggtaatgattatgatagggttgtttagtatttagaaaattttttgataaattgagttattgtttataaatgaataaaaaggagaaaagtttattttaaatatattttttatattatatattattatattttttattggatattaaattttatggaaaatggtaaaaataaaaattgagagataatttttagattattttaatatattttaaaagtttttattttggattttttttttaaaaagatttattttttttatatttttattttgggttattttaaaaaataaaatttagatgtttaagttatatttttttggataattttataaatttgtaaaaattaattattgtgaattgaaattaatatgattttttttatttagttttaaatttagtttttttttttgttttaaatttattattttttgttaattaaagtataagtatttttattttggttttagtgttagagtattggtttattattatgattttattgtatatttatatttttgtattttataaggtattttatagatttgatggttagtatgatggtaagttgtatttaatttataaatattttatagaagttttaatttttagagatggagaatatgttgtggaggtttgtgtgtatagtgatggaggagatggagtggtgttttaagttaaaattttaggtaagtgagttatttaagatatattttaattaagtatttgtgagtttttagattttgtggatttttaagggtagggataagtttgatatattagtgtttatatttttttaagtagattggatatattaaggattttttgaaatttggtatttttttttttatgagttataaaagtaagtttgtgatatattatatattttttgattattatttggatgttaaagtatagttgaaattttttagatataagatgaatgagtttttgggatttaatatatagtatggaatatattagtttatttgattgtggtaattattatataatgtatatatatattaaatttttatgttgtttattttgaatatatttaatttttgttagttaaatatttttaaataaaaagtataattaaaatggtataatttattgaatattatataatattaggttattatttaataataattaaatttttattaaaaggaaatatattaggttatttttaatatttttataatttttttatttggattatagatattgatatagtagtaaaagagaaaaatattaaattatagtttttttgttttttttttttttttattttatttattttttttttataaattttattttttatatttttgtttgatttggaaatatatatatttgaggtagttatttttttttttttatttttggtaatttgttatttaatttttgatatattttttttaatttatatgtatgatatagtttaattatattgaattttaatagatgttaatttgagaaatgtatgagaggttttgatattattagaagattttagaataaagatgataataaataatttataagaaaatttggttaatttgtataataaattttatgatataagtttatttgtataataaatttgtatatatatttttgaatttaaaataaaagttaaattttaagaaaattaaaaaaaaagaaaattgaaaatttggtgattttgatataaagaaataaatatgttatatattaaattaataaaaaattttttattataatgttagagtatttaatggtatttaataaatgttggttttaattgtatgttatgtttttgtgaagtttgttataatatatatatatattttttataaattaaaatagaattttgattttttttagtttaattattagtaattttgttttttaagaaaatagagaaattatagagatgtgaaaggaaaagaaaataattatgttttaaatattttaaaatagttattgttaatgtttagttgaatttatttatagttattttgtatatatatataattttatgttttagtttttatttttgtaaattatttaaaaattataaatgatatttttttaaataaatatgtaaatttattaaagtttttttttattataaataatatttttagagtttatttttataaattaattttttttttggttaaatttaagataaagtgttttaggttgttaaatttttttaaaaatatttattaatttttatttttattattattgagtataagtgttttttttattgtattattttaatattattgtttttttagttattgttaatttgataggggaaaatagaatttttttatttttgaaatattttttatatttagaattttgttaatatttttaatagttttatatttagtgggtagttttataaaaggaaattagagggaaatatggttattattttaaggaaggtaaagtataaataattaaataaattgtttttgaattttgggtttttttttttttgtgtagaagttagttatagtgagtttttgttttttgtatttatttttggtttattattttttattgaaaggagaatttagtttttgggatttagattagaggtttttagtaagagatgatgtagtagtgatggtaatattagtttatttattattaatggtattggtaaatgttaaatagtagaattattagggataggggaaagttttgtttataatgtttgtttgtttttgtggtgtaaatatttttattatgtgtgattttaagttttttaagtgatgttatttaatatggagttgtgaagagttatttagtagtatattattatatgtaattgttattatataggtataataagaatttaaaaaatatttgataatattataatatagtaaaatattaagaaatgatgggttttgagtatttattatatttgttttaagtttttaaatttaagtttatataaattttattttaataattatatttttaatatattgtttatatattttttaaaaatttaataattggattttaggggttgtattggttgattttagtatattatagttgtaatttgatattttagtatatatagtttatgtatagaagagtatttttttaattttaaatttaggatattttttatatttttttttttttgttaattaatggataatatttttattgattttagaatttttattatttattttttattttgattataattgtataaataaattgtagaattaatgttatgaaatgttagatgtttggtgaataatattattttagaatatttttgtttttaagtttggatttttaaattatttaaattattttaatgaggtaaatgtgtaaatataaatagaaattataggtttttttttaaatttaaaagatttttagtatttttttttggtttttatgttttaaatatgtagttaggattataatatattattagattttaatgtttataagtattatgttgtttgtttatttatttatttaataaatagatattaaatgtttataatatagtaattatagtttatatatttaaaatgtgttaagatttatatatttttatatttttgtttggttttgttgtaattttaatgatttttttgttttttagtgttggttttttaaggtttattatttatgtaatagataggggggttttttaaaatataaattaaattatataatttttttgttagaaagatggtttatagggaatggtgtgaattttggaggtggtgtttgtagtgagttgaaattgtgttattgtattttagtttgggtgatagagtgagattttgttttaaaaaaaaaaaaaaaagaaaaagaaaaaaaagaaagaaagatggtttataggtaatatttatattttttattgtggtttatagtggtttatataatttatttttttttttattttaattaagtgttttgtttttttttttgttgatatttttttttttgaatatattagtgttatttttgttttgaggtatttttatttgtttttttttttgtttggaattttttggattttggtatgttagttttatttttattatttttgtttttgttttgatgttatttttttagaaaagttttatatatggttagtaattaaggtagtaggttattttgagtaaattttttttatattatagtattgtttattttttattttaatgttagtaattatgtaaaattattttatttattaatttgtatttgtttattatgtttttttatttttatttgaagttaagttttatgggagtaagtttttgtttgttttagttgatttttgaatttttagtatttaggggattatttggtatgtagtagggttttaaaaaataattgttgaattaatttatgatttttgtatagagaaaagtttattaataagaataatttgggtaatttaaaattatagtttttatttttagaaaattgatatatttttttattaggtttatgatttatattattttatgtgttgatttgtaaatttgatttttaaaaaaataagatttttttttagatatattttggaaatattttagatttgattatttgtaattgtatttttatttgatttgaatattgttatttattgttttaataatttattttttattgaatatttgtagtgtatattaaggtaaatgtaatattataaatgttttattatatatatattatttttaataattttatattattttttaaaaattgtttttaataattatgagtaaattaagaaaatatatatatagttataatttttaatattaatttttataagttaatttggattattatatattttttataaattttagaatattaattgataaggatttttggttataaataaatatttttagagaagtatatatttaattatttgtagtgagtatgtatattttaagtttttatttttttttttagttttaaatagattatagatagttgaattaagaaagattgtagaatattttagagtttgaatatttttttatggaaaagaagtagttatttgaaatttttaaggtaggagtaatatgattagatttttttatttggaaaattatattggtgattgttgaaaatatgtataggaggggattaagatataaggagatgaagtattaggttattgttatagaatgattaaaagataatgatgttttgggttgggtgtagtggtttatgtttgtaattttagtattttgggaggttgaggtaagtggattgtgaggttaggagattgagagtattatggttaatatggtgatattttgtttttattaaaaatataaaaaaaaaaaaaaaaaattagttgggtgtggtggtgggtatttgtagttttatttatttgggaggttgaggtaggagaatggtgtgaatttaagaggtggagtttgtagtgagttgagattgagttattgtattttagtttgggtgatagagtgagattttattttaaaaaaataaaaataaaaaaataatgatgttatgatgttttgaattggaaagaaggtagtggtggatgtttagggtagattttaaaagagtaaggtattttttttatttgatttaaagttattatatatttattttgtgtattttgttttttaataaatttgtaatttattttgatattattattgatgatgtaatttgtatatttaatttaatatttttgttaattttaagatattaagttaaattgtataattaaatttattgatttaaatattgtgatggaaaatatattttgttgttttgttttgtttttttttgttagtagtagaagaaggtttagaaaattattttttgggtagaatttttatatgtttaattttattattatttttgtttttttttttttattttttaagtattgtagtgtaagagggataagaggatagtaggatgtttagatttattttatatgttattatatttagtttgtgattaagatataattagatattattatttaggaaatgttgtttttttaattattttgaaataattaaatattttgtttttttttattttattttttatgggattaatttgagtatttaagtatataaatttagtttatatattttagattgataaatagtttatatttaaattatttttaaaatgtatattttttttattattattgaattatgattaattatttaaagttttgtttaattatataaatgtatttagtatttttagttttgtaataaatatgaagttggaagataaattatttggataaagtaatattgtgtgagtttttaaatttaattttgggaggtaatttatagttttgatgattattaatataatttttgtagtgattaggtttgatttagtagttgttggataatttttagtatagggagtttttagagttttaattgttttttagaagttttgagtataatttttagaagtatattttaatattttaattatatgttaggttgtgaatagtatttttgtatttaaattaatttaggtttttttaaattttttttaaggtttttattagttgttattaagtttttataataattttaatattttattttgtttatttagttagatttagaaataattttgttgaaatattttttgatggaatatatgtaagaatggaaaggaaattttaaaataattttttaagatgtattttttattagaataatttttattaatgaaataaagttttagtttttagagttatattttagtattataatgtgttaatgatttttttttatgataaaataaaatttattttttaaatattatagatttttaaaaatattttgttttttagtaaattaatttatttaataagtgtttaaatattaattatatgttaggtattttgttgggttattggttataataattgtaaatttttttgaagtttttattttaatggatattagaagaataaagaattaataaataaataataaaataattagatttaataaaaatataaggaaaaatgagtggttttttatatttttttttatatttaaagagaaaaataggtatataagtttttggtaggatgattaggttaagttttattaagaaggtgatgtaggttgaaatttaaaggataggaattagttatatgataaaagtgtgggtaaaggaagagtttgttatgttaaggatttgaaaggaggttggtgtaattagtgtgtagtgaggatatagagttatatgggatgaggttggagaggtaagaggggtaaagttatgaatagtttggtattgattatatttaaaaggtaatatttagatgtttgtaattttttgtaagtttaatagaaaaatgttgatgtgtttttaggagatgaaggatatgatttaatttaagattatttgttgtttttgtgtagaaaatagattggagtgagataagaggggagggagttgatagagttagtgaaaagaaagtaagtttgagatataattagaataaggtatttttttttagaaataattaatttataggttattgtaggtttttttatgattttaagaagtaaagtaaattatgataagattttttttaggataaatggttaaagagtgtatgtgaagattttagtttttttttttttatgattttttaatttttttttttttgttttttggtggtaggagagtttggagggaatgtagtgtttatatttttattttagggagatgtaggagggtattgagagtaagaagaatgatgttgagattttgagagaaaatgttttatattttttaaaaaaataaagagttttttatggtaattattaagattaatttagagaattaagttaaatgtggattttttaggaaatatgaaatgaaatgaaagaaggataataaattagtttttagtttttaaattagttttatggtatataaattgatatttttagtagtattattaaaattatagaataaaagttttagatgttgaagtgatatgatgatgatatttataagtaagatttatttaagatttagaaaatagtgattaatataatttaattattaaggtttatagataatagtgtagttattatatttagttattttttatatttttatttttagtattatgataattttataatggatatttttgtatatagattttttttttggatttttaattatttttttagaatgattgttagaagtgtaatgattggattaaagggaatgattttttaaaggtttggtatatatttgttaaattgttatttaaatagtaatgtttgtattttattattaaataaatttttgtagtattttgtttttttaaaaatttttgttaagtaaaaatattattttattattttttgttattattaatgtaaatatatagatgtatttgatagttgtttatagttttatttttgtaaaattttgtttatgttttttttatgttttatgttaagaattttttttaaaatgttataattaatgtataaaggaagattataaaattttttttgttatatttgtgtaaatatttttttaggtttgtttttaaatgttattaatgatggattggtatggtttatttttatgtaaaatgatgaattttgattataaaagtttttaaatatttaatgttgaatataaatagaaagttataaaataatatatataaggttatgtattatataataaagtttttattaatgatgtattatatataagatggtggttttataagattataattttatatttttgttgtattttttttatatttatgtatgtatatatatatataaatatttgttattgtattataattggttatagtatttagtatagtaatatgtttatgttgtggaggtttgtattttgagagtaataggttataaatatattatgttttttaggtatagttatatgtttgtataatgaggaagttgtttaatgatatttttgtgaagatatttttgttattaagtaatgtataattataagtttatttatatgaagtttaaaattagaaaatatattgatgtttaaaggggtttgtgtgtttaatatatatatatatatatatatatatatatatatatatatatatttatatataatatgtgaaatttttttaaaaaatttagtttagtgttgtttttgtggagtgatgggggaattattaggaagaggtttttggggtagtgtttgtgttttatttatttgtttggttggtgagtataaaggtattgatggtattgtttttaaattatgtttttaggttagatatggtggtttatgtttatagttttagtattttgggaggttaaggtgggtggataatttgaggttagaagtttgagataagtttgattaaagtggtgaaattttatttttattaaaaatatgaaaattagttgggtatggtggtatatatttgtaattttagttatttaggaggttgatgtaggagaattgtttgaatttaggagattgaagttgtagtgagttaagatggttattatatgttagtttgggtaatagagtgagagtttattttaaaaataaatgaataaataaataaataaagttttaaaaattattaatttatataatttattttaaagtggtaaaagttaaaagaaggttgaagtagttgagtaaaggatagttagtttggtattttggaggtttatgtattagttttttagagttgttatgatagtatatagattgggtggttttgtttatttttttaattttgggggttagattaagatgttggtagggttggtgttttttaaggtttttttttttggtttgtagatggttgtgtttttttatggtttttttttagtgtgtgtgtgtgtaagtatgtgtgttgtatttttttttttttataaggattgatttgtattgttttagatttattttaatgattttattgaaagattttattttaaatgtagttattttttgaggtattagggggttagaattttgatatatgaatttgagagggataaaattttgtttaaatagaggttattggtaggtttaagagagtaatttttataaaatagtgtgggtgaaagttttatttttttaagtaaattttatagaatttatattttaaagtgaggaggtaaaataaataatatatagtaatatataaagttttgttagatagtgatagtatttgaaggtagttgaggaaggtaaagagaggtgggagagagtaagggtatttgtttttattaagagtgtagggaggggtttattttgataaggaaatgtttgaaaaaaaatggaataaagtgagagaaaagttgaagaagttatttggagagaaggaaatgtatttttattagaatagtatgaaagttttgaattggttgtatgtttagatgtttaaggaatagtaaggagattagtatggttggggttaagtaagttatgaggtgaatttgaattatagagttttataggttttgattaaggattttagattttattttaaaggtgatgagaagttattgaattagtttaaggtgggaagtgatatgattagatttatattttataatagagtattttaattattttttggaagggaagtagaaattttatgaatggtggtgtaaatttttgtgaatttttggaaatagggggattagttaggtgatagtttaagtaagagatgaagatagttttgattagtgtattaagagtagaagtgggaggtagttatattaaggatttatatggaggaagatttaatagtattttttgatgattttatgaggtatgtgaaatggatatggtagaattttaaggatttagatagattagtataattattttttgaaataattagtagaattatatattaaaatagaattatttattgaaaatatatgaagaaaagaaggagtattttaaattttgataagttgagtttaatatgttagtttaatatgtttatgagatattttagtggagagagagaaaaagagaattatttagtaaaattgagaaagtagttgaggttagatgatataaatttgttagagaattaattggtataattatataattttatttgtaatgtatattagtttggatggagatggaggaaatagagatagtagatgttttttggtgttgtttaaagttggtaaatggtatggttaatataagtggagattaaggaaaataaggatttattatttttagttaaagaataattaaaattgttgaatagagttagtattatatattatgaatattagaatatttttagttgttagtaataaatttttaatttaatttttaatttaaaattgtttaagaaagtttttgtggaattagtgttttaaaaatataattaaagaataatttttttttatttttttatttgagaggttttagttttattttaaggtttgttttttttgtggttgaaagattttgtagatgtgttaggaattatatagattttataatgtttaagaaagaagagggtttgttttttttgaagttttatttttaaaggaagtttagtttttaatagaagttttttagaaaaattttttttataatgtttagaagtgtgttaaaagtttttttttaaattagttaaatattatttttataattgtttaaagtgattaagatttatggttggtttgtgattgagaaaattttttttgatgagtgaataatatttgaataaaatatgaagagtattagtaaagaagtagagagagaaagattttttgtatgatgtttaaagttaaatagtgaggtaaataaatatagatataggatatatatttagagaaattagagatgaggaaattaggttaaagagtagttttataaaaatgtagagaaagttattttgggtagtatggttatttttatgatattgattttttttatttatgagtatggaatgtttttttatttttttgtatttttttttattttattgagtagtggtttgtagttttttttgaagaggttttttatgttttttgtaagttggatttttaggtattttattttttttgaagtaattgtgaatgggagtttatttatgatttggttttttgtttgtttgtgattggtgtataagaatgtttgtgatttttgtatattgattttgtattttgagattttgttgaagttgtttattagtttaaggagattttgggttgagataatggggttttttagatatataattatgttatttgtaaatagggataatttgattttttttttttttaattgattattttttattttttttttttgtttaattgttttggttagaatttttaatattatgttgaataggagtggtgagagagggtatttttgttttgtgttagtttttaaagggaatgtttttagtttttgtttatttagtatgatattggttgtgggtttgttatagatagtttttattattttgagatatgttttattaatatttaatttattgagagtttttagtatgaagggttgttgaattttgttaaaggttttttttgtatttattgagataattatgtggtttttgtttttggttttgtttatatgttggattatatttattgatttgtatatattgaattagttttgtattttagggatgaagtttatttgattatggtggataagttttttgatgtgttgttggatttgatttgttagtattttattgaggatttttgtattaatgtttattaaggatattggtttaaaatttttttttttggttgtgtttttgtttggttttggtattaggatgatgttggttttataaaatgagttagggaggattttttttttttttattgattggaatagttttagaaggaatggtattagtttttttttgtatttttggtagaatttggttgtgaatttatttggttttggattttttttggttggtaaattattgattattgttataattttagagtttgttattggtttatttagagagttaattttgttttggtttagttttgggagggtgtatgtgttaaggaatttatttattttttttagattttttagtttatttgtgtagaggtgtttgtggtattttttaatggtagtttgtatttttgtgggattagtggtgatattttttttattattttttattgtgtttgtttgatttttttttttttttttttttatttgttttgttagtggtttattaattttgttgatttttttaaaaaattagtttttgggggttttaattttttgaagggttttttttgtttttattttttttagttttgttttgattttagttattttttgttttttgttagtttttgaatatgtttgtttttgtttttttagtttttttaattgtgatgttagggtgttagttttggattttttttgtttttttttatgggtatttagtattataaatttttttttatatattgttttgaatgtgttttagagattttggtatgttgtgtttttgtttttgttggttttaaagaatatttttatttttgtttttattttgttatgtatttagtagttatttaggagtaggttgtttagtttttatgtagttgagtagttttgagtgggttttttaattttgagttttagtttgattgtattgtggtttgagagatagtttgttataatttttgtttttttatatttgttgaggagtgttttatttttaattgtgtggttaattttggaataggtgtggtgtggtgttgaaaaaaaatgtatattttgttgatttggggtggagagttttgtagatgtttattaggtttgtttggtgtagagttgaggttaatttttgggtatttttgttgattttttgttttgttgatttgtttaatgttgatagtggggtgttaaagttttttattattattgtgtgggagtttaagtttttttgtaggttatttaggatttgttttatgaatttgggtgttattttttttaagttattaatgattttttttatagaattggaaaaaattattttaaagtttatatggaattaaaaaagagtttgtattgttaagttaattttaagttaaaagaattaagttggaggtattatattatttgattttaaattatattataagtttatagtaattaaaatagtatggtattggtattaaaatagagatatagattaatggaatagaatagagtttttagaaataatgttgtatatttataattatttgatttttgataaatttgggaaaaataagtaatggggaaaggattttttatttaataaatggtgttgggaaaattggttagttatatgtagaaagttgaaattggattttttttttatattttatataaaaattaatttaagatggattaaagatttatatgttagatttaaaattataaaaattttagaagaaaatttaggtattattatttaagatataggtatgggtaaggattttatgtttaaaatattaaaagtaatggtaataaaagttaaaattgataaatgggatttaattaaattaaagagtttttgtatagtaaaagaaattattattagagtgaataggtaatttataaaatgggagaaaatttttgttatttatttatttgataaagggttaatatttagaatttataatgaatttaaataaatttataagaaaaaaataaataattttattaaaaagtgggtaaaggatatgaatagatattttttaaaagaagatatttatgtagttaaaaaatatgaaaaaatgtttattattattggttattagagaaatgtaaatgaaaattataatgagatattattttatattagttagaatggtgattattaaaaagttaggaaataataggtgttggagaggatatggagaaataggaatatttttatattgttggtgggattgtaaattagtttaattattgtggaagtttgtgtggtaattttttaggggtttagaattagaaatattatttgatttagttattttattattgggtatatatttaaaggattttaaattatgttgttataaagatatatgtatatgtatgtttatagaggtattatttttaatagtaaagatttggaattaatttaaatgtttaataatgatagattggattaagaaaatgtggtatatatatattatggaatattatgtagttataaaaaatgatgagtttatgttttttgtagggatatggatgaaattggaaattattatttttagtaaattattgtaaggataaaaaattaaatattgtatgtttttatttataggtgggaattgaataatgagaatatatggatataggaaggggaatattatattttggggattgttgtggggtggggggaggggggtgggatagtattaggagatatatttaatgttaaatgatgagttaatgggtgtagtataatagtatggtatatgtatatatatgtaattaatttgtatattgtgtatatgtattttaaaatttaaagtataataataataaaataaataaaaaaataaaataaaaaatttagagaaagagtaatggaaatttatagaaaggttaggatgttagttttaaaatgtaggattgttttggatttaagaaatagaaattgttgataagatggatattgagattaaaataatttatgatgttgggtaaattgttaaggattatgttaataagttgagttgtaagaattttggtgtaaataaagttagtaaatataggtttattttttaaaaatatattatttggttttattattgttaaataatatttaagtagttaagtagagaggaatatttaaggattggtttatattattaatgatataaaaattgtaaatgtttttgttttgttttatattttagattagttattttataattttgaaatttatgaggtaaattttttattttaaataattgtatttggtgatgtgttttaaatttagaatgttatattgggagggtagaatttggaaagaatattgttgaaggaattaaaattggaatttagtatgaggaggaatttttatatatagtgagtgttttggaaaaggatgttagaaattaaagaaattaattatttttggagaatgtaattatagtgaagaatttttggagaatgaattaatagttttaagggagatatttttatttaaagatgattttatttttttgagtattgggtattagtaaaattttaattttattaaaaagtaatgtgttttttttatttgtaagtataatattaaggtttgagaaattttgttgtaaagttttaattaatttatgatatatgtatgaataaattatttatgagaaaatggataattttttataatgatttatatgaagaattttaattattggtaagtttaattttgtatttttttatgaatgttgatttattaatgatataaaaagttatattaagatatttattttttatatttaagtggattgaaaatattttgtttttaaggatgaattaagatatatttatttttgttttaaattataggatattattttatttttttttttgaaataagagtaatataaaagttaattaaaataattagattatttttaatagatatatgtattaattattagaataagattttaaaatttatttttttttgaaatattataggttgtgttgaaatttgtaatttttttaggaaaatataaaaataattgtttgttttgagaaagggagttgggttttaaatttttttttttgaggtttgatatttatttattataatataaatttgaaaattatttagaaaggaaagtgattttgtgatttttaaaaataaaatttttgaaattttttataaatattattggaagtttttaatgttatagtaagagggaatataaaatgtttaaattggaaagtgatatgttaatatattaaaatggtttatttgatattatattagggattagttttagtgatttatgaaggagtatttaggttttaaagtaatttttatagttgggtaaggttagaagttaggttttttggtagattttttatagtatgagagtagtgtaaaggatattttagaggtagtttttatagatatattttgtaaaattatttagattaaaataaaataaataatttagaataattttaagagtatgagattatttagttagtagttttttttttataattttttattttagggtttgtatatttgatttttattttttttttttaaaaatgggtttaaaagtaaataattagttttgggttatatggttaggagaagtaagaagagtgaaggttattgaaggttatagaaaatgtaggaagagttgagggtgtggtagagtatagagattaattttttaagttttttagtttatagagatgttttagaattttgatgtgtttgaaagttgtgaatttttaggatattaatatttatgtagatgatttatttaatgttatagttttttaatttatttaattttttttttttgatgattttgttttgtgttttgttttagttatttatttatgattataattgaaataggaatttatagattttagtgtgaatttgaatttgagggatttttgaaatttggatggtaaaaaattatattataatttttatgaatttttaattgaaatttggtattttaaaatatatgaatttaggttatatattattttgttattaataataattaaatatatttttatatattttagttgttgaagtattattttaataatatattttttaaatttgtttttagattttgttatttaatgtgttaataagtatattatttgaatgtgttagtaatttatatttggttttttgatatttttataaatgaattttaatataataggtttttaaaaaattttatgtattatattttatgtatgtaataagagtattatttttagtatttttagaaatttatagattattaaatgggtttatgatattaaaaagtttaagaatttttgtaaattttaatattattaataattgtaaatttttttttttaattttgattttaaatattgtgttttttgattattgatttttttttttttagtttatttttttaaatttttttttaattttagtagtttttttatttttttttatttagattattagtgattttattgtttattttttttttttttttttttttttgttttttatttatttttatgtttttagtttttgttttgaatgttagtttagattttatggtttatattgaaaataattgttttatatattttgtttttttttttttttatgttttttatttggttaaatttaaatttatattaaatataattgtttatattttatgtgtttatatttaggtagaaggtagaagttatatgtttttattaagattttttttttgtatttttattttttttgtatttttatttttaatatttatttttttattagtattatatatttagagattttgagatataatttgtttatgttttttagttttgtttatgatagttatttatagaaatttaggagtttttgattaatatggatttaggtgtttattttttgatatttttatttatattttatttttaaaatttttttattgttttttttaaaatttattattagttattagtagagttttttgtaatttttatttatttattgagtgttttttttattttttaattttatttgaagttttgttttttttgatgatattgttttttttgtagtttatttaaaagtggtggtttttttttatattttttgaaggttgtatttggtggagggtagttgatttttttttttgttatttttatagtatttttttttttttttgtttaaaaagttttgtttggaattatattattatttttttttatttattttttttttttgtttaagttttttattagtttttagggttatttttatttattttatggagattttattttttagataatttttattttttttaaatgatattggagagaatgttatttttttttatattttttttataagttttagtgatataatgtaggtataaatgatttttgtattattttgttttttttattttttttttttattgatgttttttttatggttttattttagttttttttattattatttatataattttaaatattttattttttgtttattttttatttttatttttatttttggtatttagatttttaaaagtttttgatttattaggaaggataagttattgatttgattattgtttgtgttttttattttttttgtatttttattttttttatatttagtttaaattttatagttatataatataattatttttttgtatagattatttattttatttagaagtttttttttgttattttaattttattatatttatttggttaaaggagtggattaaatttaatttattatttgttttaagtttatatttttatggttaaaggtggttagagaagaatgttaatatgaatattggttttattttgaatttatgattataaaattttaagtgggtttatagtgttgttgggttattttattagatttttttagtatatttatttttttttttatttagaaatttattttatatttttttttttttttttttttaatttttaatatatttttattattttttttttttagttaatgattttgttttttatttttttgagaaataaaagtaatttgaagtagttgatatttatatatatgtttatgtgatttgtttttttttttaagattttggttgaatgttttatgtttttaaggatatttttttatatggaagttagattttaatattttttgttaatttaagaatattgttttaattattttttttttttttttttatattattatatttttttttttttatttgattttttttattattatataagtattttgtaatattgtttatttttaaggggggaaaatataaataagataaaataaaatagagtaataattgaaagaaagaagaaggaaaaaaatgaaggaaggaaagagggaaggaaggagagaaagagaagaaggagagaaagagaaggaaggaaggaaggaatgaagaaaaataaaaaaagaaaattttttttagtaattaatgtatgttttattattttttttggagtaaaatttaataaataatttattatttttattatttaattttttttttaaaattttattttaaatttgttttaattagatttttattataatattttgttaaaatagtttttgttgaggttgttaatgatttttatgtttttaatttaggagtagttttttttttatttaagtttttagtagtattgatgtatatggttatttttttttttttggttttttgggtattagtttgttttgattttttttttttttttaagagttgttatttttagtttttttttttggtttttggtaattattttaatttttgaattttaaagttttttaggatttagtatgttagtaatttttttttttttagtttttaggtaattttatgtagttttgaggttttaagtgtatgatatgtatttgtagaaaataattaaatgttagttttttttgatttatttagttgtttgattgttatttttatttagatatttaatttaaatttttttttatttttttttgtttgttttttttgtagttttatttattttaataaagtatttttaattttttttgaagtaatttttggtattattttttttaatatattatatttattttattaagaaattttgttggttttattattaaaataaatgtattgagaaatatttatttttgttgttattattatagggtttagttattgtgttttgtttttaggattgttgtattaattatttaattgtgttttttgtttggtgtttaatatttataatttatttttaatataatgattatagtgattattttaaaatatgttagttttttttatgtttttgtataaaaatttttaatggttttttatttgagaaggggattagattatatttatatttgtattttgtttgatttttgttaatttgggttattattattaattttttagtttatgatatataaattagtttttggaaaatataagtttgtttattttattttttaatgttttgtaaaatttgatttaattaattaagatgtttgtaatttttttgttttgagatggagttttgttttattatttagtttggagtgtagagtagtataattttggtttattgtaatttttattttttaggtttaggtagttattttgttttagttttttaagtagttgggattataggtgtatgttattaggtttagttaatttttgtatttttagtagagatagggttttgttatgttggttaggttggttttgaatttttgattttaggtgatttgtttgttttggttttttaaagtgttgggattataggtgagagttattgtatttagttaagatgtttataatattattataaatttatgtatgtttttattatttatatgttgtattagtttatttttatattgttataaagaattatttgaaattgggtaatttataaagaaaagaggtttaattgatttatagttttataggttgtgtaggaagtatggttgggaaggttttaggaaatttataattatggtagaagggtaaaggggaagtaagtatatttgtatatagtggtaagaaagagagaagggggaagtgttatatatttttaaataattaggttttatgagaatttatttattattataagaatagtaagggagatatttatttttatgatttaattattttttattaggttttttttttaatattggggattatagtttaatttgagatttgggtggggatatagttaaattattattatatgttttgattatttaatataggtatgttttttttttgtataaatgagaataatggtgtttatttttgatatgagttataaatgaataaattaaatttgtttttatatattttaaatttttgttatttaattataattggaagtatgagtgggaaagataatattttatattagtattttttaaattttttttattattgtttttttaggaagttttgttatatattatttttttaagtgttattatttatgaaattttaatattaaaaatttattgtatagttgtttatgttatgtggttttttagagatttaaaattattatgagattttagatttttttattttataagaattaatttttatttagttggaggttatgttggttttattgagaatgtatgtttggtggagatttttatttattttattttttggagatatagtaaattttatgaattaattagtttaaatttttagtgagttgtgtttttagaatatattgttttgtgattttttttttttttttttttttgagatggagttttgttttgttatttaggttggagtgtagtggtgagattttggtttattgtaagttttgttttttaggtttatgttatttttttgttttagttttttaagtagttgggattataggtgtttgttattatgtttagataatttttttttttattttttagtagagatagtattttattgtgttagttaggatggttttgattttttgattttgtgatttatttattttggttttttaaagtgttgggattataggtgtgagttattgtatttagtttgttttgtgattttatataattaattttgtattgaattgtattttagttttatgttattggtttagattgagggtaattaaaaataaagtagagaaataaaattaaaaaaaatatataaaatttattattatattattttataattgttgaggatatatttttataaaatatatataaaaatgttttttttttaaggaattgtgaatgaaagtttttttaggtaggggtgaatttatagaagtgagtattttggtttaggttaataaataaatatttaatgtttaaataaaataatttaatattaatattaaattagttttgaaatttttgtatattatgtatttaatggagaagatgagattttgtaagaggaagaatgtaaggaggattatttttgtttaaattttggaatagtttattttttaatatttattttatataaatatatatatatatatatatatatatatatatatatatatatatataaagaaatttatagttaaataatttattttttgtgagtagtgtagatattatttattggaatgtattaaatagtagatttattttttatatatatatattttaaatagtttattagtatttttttttagtagagaattgtgggggtagaatattgtgataaatatgtttttttaattttttgtatttttagtattgtgttggtatttagtatagtttatattttggatatttgtttaattagattgttttataaattttgtttttggttttaagattagaagtagataagttttttttgagatattatttgtttttattttttggataaagatattggaaatttaatggttgatgtatttttgtgtttgtattgtatggttaaagtttagagttaaatttgttatatgtttatagtaaaatatataaagtattgtatattttattttaaaatgtttgaatatatatgtagtggttttaaaaagtgtttggaataatatagatataataaatattagtaatatttgtattagttttagttgatgttgttgttattttggtattattttttattttgtattatgttttttaattttattttttttttttttaatttttttatttgttttttttattatattttatttatttttgtaaattattagaaagtttttttagaatgaagtagtttataatttataagtaaatatttatattttattttttaaagaatttggtaaattattttgatttagtgtttgtttttttaatttaattagtaaaaaaagttttttagataaatattgttggattataatatttggaagattttaatagtaaatgttttaagaatatttatttatttttaagaattataaaatatgaattggatttttagtatatgttttataattaaatttaagttaaaaagaatttttgaaatattatttaaagttataaagaatgtatttaaaatgtgagagttaataaaatttaaagagaaaatttttaaaataaaatggatataagaagaaaaatgaattaaaaagtatttatatatttagtaaaataaatgtgtttagaaaatagagaattggtatgtgtgattttaagattatatagatattataatttaagtagaagtttaaaatataaagtaaattaatttgatagagaaatatttgaagtagaaaaaataatgatgttattatatttgaaaaatatagtttttataatttttatatttttttaagtattttaagtgtttttgtgatattatatagtttgagtttatttttagaaagttttggtttttataaataaaaagatattttttttttttatagagttattatgaatggttgattaaatttttaaatatataaatatattgttatggatatatgatatttaaaatgaatttgatgtagaggaaaaagtagtttatagataaaatttatttagattttgttttttttatgtttttattaaatatatatatatatatatatatatatatatatatatatatttgttaataatgtagtgttagttttttataaggtggtttatttttggaaatttttgttattttgtaattttgttaattatgttgttttttatattgatgatttagatgtttgaatatattttttgtagttttttgtagttatatgttattttttttgtttttgtttttgggattgaaaattgttgttattaagaatttttaattaatttttaatagattttaaaataattaatatatatttaaatgttattataaataatataatgttagtttatatttattattatatttgttgaattttggatttagttaaaggaataaagaattatttaatttagtatttttttattttgattttttaatttttttttatttatttttaaaataaatatagtgtattattaaggtaaaagtttttaaaattttattgtttttttgtttttttattttttaaaaatatatattgtatgttagtttttaattgtgtttatggaaatttgtaaaatattaattaatattttataagttagataaaataaatataaaaggaaatattttatatttgaattttagaggttaattttttttttttaaagaaagagaagttatattatttttaaattaaagtgaaaatgagtatgtttttttattgttatttgattatttaggattatatagtgttttaaagtttttatattattttttttggtataagatttatttttttaaaatttgagaatgataaaattagtaataaattttgttaggagttatagtattgatattgggaaaaaataaggtaattatattataggtattagtaaatatagtattatatatattttttagaatatatttgattataaatatttttttataaattaagtagatattgttgttaatgtttaatattttatttattttttatggaatataatatgtatgaggtaaggttagttatatataagatgaaaaattatggtgaaaatatgattagagtatttgttttagtaaagagagaaatggtaattttttttttattttaaatataaataagttttttatttttataattaatttattgataatataaattaaagtatttattatagaatatagtagttgtttaattattttattgatttttagtagttattaatatattttgtaagttagtatataaataaggtattttatatagaataatgtttttaaattatattattagttgttatgttatatttaaagaatttattttttagttattagatgtatttgaatgtatttatgtgatttagagaatgttaagttatgtaatatatttttgtaaatttgatgaatttttatttatatgtgttaattttaaaatattgttttaattatttaatatattttttatatagttttgttgtatggttaatgaatagtatgttatttgtggtttattgttagttatttttaattagatgaaatttaatattgtaagttttaaaattgaagattaggtattattttaagtagtaaatatttttgttttggtttttttttaggttaataatttttttgatatttgtataattgtgtttgaaatatagtttaatagaatatgtatttgttttttataaaattaatgttttagatgatgataaaatatgttgaagttttaagggaattattttttttattattttggattggtttatgaattaatgaaatggaaattaatatatatgagaggattaattataattttatattaatttagagtattataagtagtggtttagaataagagtttattttttgtgaatatttaggataatttttattagttttttttttttttataatgtattttttggtaaatattttgttattattatgatagtgggtgtttttaaaatttatttatatattttgttttatttttttttttttagtgtgtttttttttttttttaggaaattttttttttgttgttatttggaagtatttttttttttgttttttttatatttttggtattttaagtgtaattgtgtttattatattgtattatagttgtggtttattattatttaattaagattttttgagaagaagaaaggttatttttgtatttagtattgattatagaagtagtgggtttttattaaattgaaatttatgaatggaggtttggtagttaagtttttttttgttatattaaaattgagaagtaattttaaagaaagaaaaatgatttggatagaaatttatattttaattatatttagatggtttttgtttatttagttaaaataattagtatttttatttataagttggattatgttaatgtattttttttagtagtgattttttttttttttttttttagttttttatatagggatattatagttatggatttgtttttattttgaagaagtatgggtattttagtatttagatttttttttgagtttgtataattttggagatgtagagtagttaagttgtagttagaagagttttgattttttttggtttggattaagtggtattttaaattttaaatattttttaatgttttttagtttgggtttggttagatattttttttttgagtttattattagaaatttttggaatgtggtttgtagagattatagataattggtatttattttttaataaataaagtaggttagaaaataattttttagttataataatataaagagttattaattatgaaatatttatttataatagtaatgtattttgtatttttgttaaaataatataattagttaattgttattattattattttattgatgaagttattgaaatttagagagtttatgtaatttgtttaaagttttatagttggttaagttaggagttagaatttaaatgatttagttttaatattaaagtatgtgtttttaatttgtatattatgttaggatgggattagttttatatggtaatttttagtaagaatttgatattgggatatgatatagtaataagagaagagaaatagagatatttagaaatatataggttattttataagtaattattatattgtagaataaatagtgaatgttagataggtatagttaaaatttttagtattttaattttaaattaaattttgttaattatttgggagaggatttgatatagtttttgttattatttaaatagatagaatttatatgatttttggaggaggaaaaaattaaataaatttagattatttttttttaattttttagattttatttgtataagtggaaaatttatttgatttagttaaaattaatatatttaaagtattaattatatagtttaattaaagtattatttaaatataatatttagattataatttattatattataaatatttggatatttataaatattatatttagatatttataaatatttataatatttagatatttataaatatttataatatttagatatttataaatattataaatatttagatatttataaatattataaatatttagatatttataaatgatatttataaatattataaatatttagatatttataaatattataaatatttagatatttataaatattataaatatttagatatttataaatattatatttagatatttataaatattatatttagatatttataaatattaagatatttatattataaatatttagatatttatattattatatttagatatttataaatattattataaatatttagatattatttataaatatttagataatattttattttttttaaagaaagagttatgtatttttggtttaagattatattttaaatataggtttaatttaaaatagattatgattattataaaaaggaagaaaggtgataaataatatttaaaaattttatatgtatattagtagattttttataaggaaaatattattaaagtttaatgtgtaattaatttagtttggtgaaatatttttgatatgtattaaaaaattaatttatggttagttaataatgtaatttttagaatatgtaatattaatataagattttgtttatatttttgaattaagtattttagtggatattggtttagatgggttgattgtttgattttaaattttatttgatgaatttggaatggaagattaagaaataaaggtagagaggtatgattggagtataagttatatttagattgtgaaaagggagaagattaagtttgtggtttttgttttttgttttttggtgttttggtgtgattttttttatttttatattttgttttttttatatataagtatgagatgatgagattttaaatttttaatgtataggtaataaaggtgaagagttgtgagagattttagagttatattggagattaaattagttggatttggtatttaagttgatatattataggtgaggaagaaaaagtattttgtaaatgatggtattttttattatgaataattaagtgtatggtattttatgaattgaattaagtagtgtaggaggatggataatttttataggagtagtggtaggaatagggagtatagagggagagagaagtggttttgtgataaatgtaagaattttaatatggaaaaataggtaaagtgaataagagataaaataatttaggtaagatatagtaaatttaaaatgagttaatgtttttaagtttttttttaggttttttaatattttttttaatatttagaaaatttattatgaattattttatatatgttattatattattattgataaatatttaaaagtttttgtttttattgttaagataaatgagtataataagatataagttttgaaaagagaaaaagtaataataattaaaaattgtatgatggaatgaataaaagaagtttggtaatattgatagaaatgttggtattgaaggaattttagttttatttatttgtgggaatttgatttgtttaatgtaaataaaatggttttttaaagaattttttagaattttaaatggttagaaagaagtaattattttgttgattttataaataaatttttgtaaaagtgatgaaagttaattttttttttttttttttttaatttaaaaagaatttgaaaagaatttaaaattttaaggtttaatattatgaaattatgattaaggatgagtttttttagaaaagaaggaagtttgaaaaatatataaatagaattaaggaaattttgtgtagatataatttaaggtgattagaattattttatatttttaggttgagaaattgaataagtataattttttagaaattttttagattagttaatgtttaattttagttagtgattttttatatattttagattatagttaaaatagttgaaaaattatttttgttgtgaaagtataaagagaagatttagtttgttatgatttttttaatagttttagtgatttaatgaatttggataattttttataagaattttatgtgtatatagtaaaatagagagatattaattaattttttttgatagatggatgatattgaattgtgaaataaggttttaagatttaataaataaatgaatttaaggttataaaaagaagaaaaattttaatagtaaatattaaatattaatatattaggagaaaaattttaatattaaatattaaattttaatgtttttaatattaaatattgattttaatattaaatattaaaatatagttttaaataggtgaattatttatttgttatagttttaaagttaaagatgattgaagattaatagaattttttgttttagttttattttgagaaagtttttagggtagttttgtttttgtattattatttgaaattagtgagagaatgggattattggttgttattgttattgaggtttttagaaatttttagttatttttaatttttaatttattatattaaggaaggtggtattattgtattttttagtaatgtttaaagatgtttatgaagtagttaggatgtagaggaaatagtattgggtttagattttggtttatgtttaatatttaagtttattgttttttaggtatgtaaatataagttttaggtttttaatttgtaaatataaataatgatatatattttaattgtattttataagaatttagtaaaataaatgttgtaatgtgttttagataaattaggtatttattaagtggtttaaaagaattaaaaaatttattgaataggttaagtgtagtggtttgagtttgtaatttgagtattttgtagggttgaggtgagaggattgtttgaatttaggagttttagattagtttgggtaatattgtgagattttatatttatgaaaaatataaaaatttagttgggaatggttatgtatgtttttaattttatttatttagaaggttgaagtgagaggattatttgagtttgggaagtaaaggttttggtgagttgtgattgtatttttgtatttatttaggtaattgagtgagtttgttggaaaaaaaaaatgaatagatatttgttaatgatatattatggattaggttgtttagaattttatgaataaatgaaataattttaaggaaaattgagttttatggttagttagttttattttttttttttattgttaatatttataaatattagttagtttttataaaaaaagagaagtaaagtaatagaatgagtaatttttgtggtgggggatgattgtaagggatagtttttttttgtatgtaaataaatttatagggttatgtatttgttgaaaatgtttaagaagttttagttatagtgtttaattggttttttaagatttgtattgaagaggaattattaattttggtatagtggaatatgtaaatttttaaattttttttttggttttatttgtttttttgttttaaaaattaatttggagaaggtaaggtagaggtagtggaaggaataatttagtatttgtttttataagtatggtaaaatggaatgggtatttgaagttgttagtttttttaattttgattgaggttgagaaaagttatttttggtgataatttagtgtattttataaagttggggttgtaaatgtgagaatattttgttaaatagttatttttaaagttaagtgtatagattatttaataaattggttttggttgttggttaattaattataaattaaaaatttgaatgttatttataaaatattttgtatatgttgggaataaaataaatttatgaaatttattatatataattttatgtattttatagaatagaatttagatattaaggtttgagttttttttgttttattttagattgagtatgtttttattaaatatttattaaaaaattaaatatttttttaaatgaatgaattatatttaatattgtaaatttataatttatagatggtttttattttgtattttaattttattatgtaagtattagatttttaattttataaataagtaaatggagtatagagagatttagtattttatgagaggttatatatttaagtgagtggtaatagtatgtagatagaattgttttattttaagttttatgtttttgtgtaaatgttattttgtatttttaaagaagtaggtaagttagttttaaaagtttttataattatggttttattttgttttaaaatattaaaattgggtttgttgagtatgtgtttattggttagttttttataaaagttagaagttgtttttatattttttagtaaattaattggttattattttattggaaatgtttattttttttttaaagaggaaatgtattttggtgatttggtgttttttgatagggaaagggttagagttaatagtaaggaataaatataattgttaggataagttgttagaaaattatgtatttttgttaaataaataaagatttattttgtttggtatgtgggtttgggtttataattgttaaatgaataggagtagaaagattagtgggttttattggatggaaaaatttattgaagttattagtatttagatgattaagtatttaatgtatatttataaattaatattaattttgattagtataaataagggaaaatgtaataaatatgtttgtaaattttatggtttaatgtttgatatttttaaatatattatggtttgtttagaattatagatttagggttgtagtaggaattttaaaatttataatattaaattttattattttatagaaggaaaatttatatttttgagaagtaaaatagttaaagattatagaagtattagaattatgttttgagtttaaatattttttgttgttaaagttatataattagttattgatagaattagaggtaggttttaagttgtttttttttttttttatttagtttagtatttgagtgttgttattttaagtaggtaaagggaaataaaattattaaaagtaaaataagtaagttgatatatagataatattataaaatagatattttagggaaaaaataaaaattattaaatgtgtaaaaattttgttgaattttaaagattaaatttattttattttttgatttttttttgggttttttttttagaaatttttaaaattaattagtgtgattatttattattttattttgttaaagttatgaagttaatgtttataataatttaaaattgaaaattatattaatgttttttttaagaaattggtttgaagttaatttagttaattttttaaaaagatattttttttgttaatattagattatttataaaaataataattttgatatatagtttaaagaaaatgttaatagtaattttattgaattatagtagtgttattgaaaattgtatgttagtttttaggtaagtataatttttttattttatagatttgtaagttttatattttaattttagtttatatttgtattgttgataatatttagataggatggaaatttggaaagaaaaaaattatgtaagagaaaatgtgtaaggagaaagagataaagatgagatagaaatgttaaaaatgaattaagtaataatttaaagatttttttgttttagatattttataaaattttagttaatatatttaaaatatttgtttttattttaatagttttatattgattaagtgttaatttaaggaagtaaatgggattgtatgaattttttaaaattattattgttagaaaattaattatataataaagtagattttagtgttttaaagtaaaatatattttttttttttttaatgtttgtttttatatatttttgttataaaatttaataaaataaatatttaattgatttttttatttagttttgatagtaatttaatggagaaataaatataatttagtaatttgtagaatggaatattattagtaaaagaattttagaaaatttttaattgattagattaagtttaaaataaagttttttattataaatttattatttttttagataaatttttatgagtgattaaatttgtaaagtggtaaatttatattaggtttttttgtataaataaataagataaaaaatgttgaaaaatttgaatgttgtatttattttgattgtgttttagtggttatttataaaaatggatttagtattttgataagtttattgaaagtgttgtttttagtagttaaagagagtatttgttttttttgtgttgattagttttaagtaattgggaaaatagttaaaagttgagaaaggtaaattagagaggttttaaatgatataggtgagtaaagttttgaaatatgtttttttaattattataaatttattagaaaatgtatttttttatagttatgggtagaatataatttttgtgtgatggtttttgatagaaagttattgtggttaataagtttgggagatattgattattttttgttgttttgatgatttttaatatgtatttatttgtattttttagatgagagtagttttttttttgttttagaattttttttttgtttttggatttatatagtttttttattgggtaaagtattgttttttttgagataagaatgaaagttattatttttttatatggttttgtttttttggttagagtgattggttgagtgatggaaagtttttttaaattagtttaattaaagaagttattaatttagttatagttattggtttggggataggtgtgtgatttgatgtttgtaaagtagagtttttttttaagaattttttattagtgttggggtaaaatgatagtttagtttgtttgtttttaagaatatgtgatgtgagttaggagtttatattttttttgagagaagttagtttgagaatgtgaggtaataggttgggtgtggtagtttatgtttgtaattttagtattttgggaagttgaggtgggtggattatgaggttaggagttgagattattttggttagtatagtgaaattttatttttattaaaaatataaaaattagttgggtatggtggtgggtgtttgtagttttagttatttgggaggttgaggtaggagaatggtgtgaatttgggaggtagagtttttagttagttgagattgtgttattgtattgtagtttgggtgattgagtgagattttattttaaaaaaaaaaaaaaaaataatgtgaggtaaattgtaaaagaataagaggtgaaagttagagatttggaagatgtaggtatttaattatttgttttagtgtgtttgtaaaatattagttgttaggttggggttttgttttttaaaattaaagatttttgattattatgttatataaatattggagttggaagttagatttttatagaaaaatttagtatgtttagtttatgttattgtttgttttattttatttaattatttttttagaaatatagtgtaggtttagaataagaaataaattttatgaaatgtagtaggaattgttattatttattgggagttatttattaattatgtatttttgaaatgttttatataaagtagttgtttttaaattgtgataagtagagttttatatgttttatggggtgatagagttgtgggaagtataggtgttagtatgaaaatagagaagataaaaatttggtggttttttgtttttaaatttatttttgagtaaagtattttttttttatttagtttaataatggatttttatatataattatttttgaagaaaggttatgttatttttttagatagatagatagatagatagatagatagatgttatgagatatattattatttttattttatagttgaaggaaaaaggtttaatttttttttaatttttttaaattaaaaaaattaaagaatatgtttaagattatttagattatgtagttagtaaaaggtagaggtagagtttgaattttgttttgtttgtttttagaatgtttgatttagttgttatgtgatattgtttttaatatatttttgtggtttttattaggataggtatttattgtttgttttattttatttttttatttttttgagatggagttttgttttgttgtttgggttggagtgtagtggtgttatttttgtttattgtaagttttgttttttgggtttatgttatttttttgttttagttttttgagtagttgggattataggtgtttgttattaagtttggttatttttttgtatttttagtagaaatggggttttattgtgttagttaggatggttttgaatttttgattttgtgatttatttgtttgggttttttaaagtgttgggattataggtgtgagttattgtatttggttttattgtttgttttattgatatttatattagttagtttgttttgttaaaattaaatagttaaagattaaatagaaatttgtagtttgataaagttagagttattgattggatgtagtaaggaaatatatattagagtaattatggaatattatgtaggtgtgaaggagaagtgttttatgtaaggtttgagtttttgttgaagaattttgaggagggtggaaataaattggtagttagatttggattagttttgtttttgaagtgggaataggagaagtaggaattaattagagttggggttgttatgaggggagtgtagtttagtaattgggtatttttattaataggtgggataagaagagtagagttggggtattattggtaatagtattatttatttggtgaggaggttatgatggtattttatagtagttttgtgattttggtagtgttttttgtgaattttatagttggtattatttatgtttgttatatgaatttgaataaaggttttgttatttttttgttttagttgatttttattttaattatagggatgtttttatttttttagtttttaaatgtgttgttttagtaggagttttattgaatttaataatttttaatgtaagtatttatttatgtgtatttaatatattttatatatattaggtatatttttaggtagtggggaattaattatttaataaaaatatttttttttatatggttagggttattaatagattttggaagaataaaaaataatgttggattaggattagttggaggatttttggattgagtagtaaaattattgttttttgatattatattatgaatttttaatattatttttttaataggaaaaaattattttttgaggaaaagtaattataggaaggtataatttttttttttgtttaggtttttagaagttagagagattatgtaatatagaataaaataaaaagaaatattaggggttatattgaaggttatagtggttttttttaattatttttttttttagattttttgtgttttgtaataagaaaaaatttagggtttataatggaggtataatttaattatttaatattataggttgagtattttttatgtattaggtttggtattagttaatatagttaaaatataatttggatattatttttgttttgaagttgtttataatatagagatattagtagttgtggttataaaatgtgatattataaagagaaaattttaaatgttatggtattgttagtaataggtaagtagtagaaataaagattgtattatagtgtttagattgaagaattagaaaggaagtttgtattaaaaattaagtagagtagttttttatttattagaaagtttgtagtattgtttaatttttaattgaaatgtttgtttttagtattattttttatatagtgggaattttttttgaaggaagtatgaaattaaagtttagatttaaaaaaaaattaagaatttttatggaagagatatagtattttaaattggttttatattttttttgatagagaaaaattatttataagattaatgatttgtttaggtttaatatttattagttatgtgaaaagtaaaatatgtgtttattatataatatataagtattagaattatgattgatagtagtattttgatatatatgttgttagatttaaaattaatatatattgaaaaattttttaagaatatatgttatttaaaatgatattagatagtattttaatttggtttttaatttttgtttggaatgtgggatagaagtaaagatgaagattaaaattatataagtttgagttattagagaaattaaatataatatatgtaaatatggagagtttattttaaatattttgatgttaaagttataaattatgaaattgtatttggtttttatattagtattaaaatattaagatggtatttataatttattaaattttttttgagtagttatagtttgtattttgttaatttatatatttagttaagtatataaatatgtttttatgatagatgtaatttgtggttaaaagatagagtattgtggagattttgtagttatttttagataaaaaaggttttagaatgatgatttttaatttttattataagaataaaaaattaaatattgtatatttttatttataggtgggaattgaataatgagattatatggatataggaaggggaatattatattttggggattgtggtggggtgggggaggggggagggatagtattgggagatatatttaatgttagatgatgagttagtgggtgtagtgtattagtatggtatatgtatatatatgtaattaatttgtataatgtgtatatgtattttaaaatttaaagtataataaaaaaaaaaaggttttaggatggattatttatattgggttaaatattgatgtttaaaggttttattgtgtgattgaggtttattattgggtattttattagaataaaataatgtgtggtttgtggtatattttaaaaaatttgtagaaaagtagaagataaaaaaaattataagaatataaagatttttttgaaatagtttatgtgttagtttttttttatatgatatttattattttttttttgtgtttttgttttgatatattaagtgtagagtgtagtttttttttgtatttttaaaattagttttttgttaaagttatttgtaagaatatggtagagaggttaaaagtgtatggtttttgtagttggataaatttgaattttaattttttttttgttttttagtgattattggatttgagtaatttattttatttgatttagttataaaatatataaaattagggtaaaagatttattattgtaggttgttgtagttatgttataatttatataatgagttaatatagttttgtagttggttgtagggtagtaagtagtattttttaaagtaatgataagtttattattgttattgatagtgtttttaggagttttgttatttgagggttgtttatattttttttgttatttgtttttattttttgatttttatttttttgtttatttttaagaattattttatttgtatttgataaagtttttttttttatgtttttaggtagttttaaaagttttaggtagggtaatgttgaagataagtaagtagatagatattattattttttattttatagggaatatgaatgtgtttttaatgattagagatttaggagaaatgtattaaatttttttgaatataaaaggattatgttaaagaatgagttgtttatggttatttttaatgtgatagataataataatttatttggtggttttaaatttagagagtaaatttttaaaaattaatgaaaattgttatattagtaagttattgattaaattttttaggtttttatttattttagtagtatgtttattgaagatagtgttagttaggtatggtggtttatgtttgtaattttagtattttgggagattgaggtaggaggattatatgggtttaggagtttgaggttgtagttagttatgattgaattattgtattttagtttgagtaatagaataagattttgtattttaaaaaataataattaatttatttaaaaagaagatagtgtttaatagttgtggatattgggaagaaagagtatgattttttggttttattttataatagttttttaaaaatttttatgttggtaggatatggatttataaatttatttgattataggagtagtttttttaagtgttatttaagatgtaaattaagtttatagtatattataatatattattttaatttttaatttatagtgtaatattttagggtaattgttttttagataaaaattgaatgagattatttaatattagaaatatattatttaagttattttgtataaatgtataaatgttttaaaattattgggatgtgaaattatgtaagatttatttagtatatttatgttgttattgttttaggaaaaattattagtatttttattgtatttttttttttatattttattattattatattttaagttttagggtatatgtgtataatgtgtaggtttgttatatatgtatataagtgttatgttggtgtgttgtatttattaatttgttatttagtattaggtatattttttaatgttatttttttttattttttttattttataattttattttatttttaaaatttatttttttaatgtatgtatatatgttttttgatattttgttttttggtaggaatttgggattgttggattatagggatagtatatatatttgtgattatattattttaaatgattaattatgttgtgtaaatagtttatatggttttatatagaaaatttttgattaaaagtttttgttttttttaaattatgtaagaataagagattttgttttgtgaaaggatttatttgttttttagggttatgtaattttgttttagttgaagtagattaaatgagtaatagtgatatgtattaatgaaataatatgtatatttttggtttattttgtaggtgtatttattttatttttaagtttttttggtttattgttgtttgtttttggtatttttgtttatttggaattttgaatgtgttgtgatagttgttgtttttattttagtttagaagatattttttaattttgggatgattataattttttttaatttttgtggttttattttaagttaaataaattatattttaataaattatttaattgatttataatatatatgatgattgaggtatttgggaatttttttatttaaaagaataaatttttaaatggatataaatgatttttaatttgttttaatatgttttataaattatttaatttgattttgtgatagttgtatgatttaatttaatgggataagttatagtgtttaatttaatattataggttgtagagtgaaagttaaattattatatataggtgttttaaatttaataataagttgtgaaatataatagagattgaaatgttggttgtatgtggtaaatgtaagagtaatatagttttttgtattttttttattg

SEQ ID NO: 70 - DNA, 91060 bp, Homo sapiens
agtgttttgaaatgtgtaaagttttttagaaatagaagtttttatttaagtattttttcgaagttttggtaagataattatttttattatttcgtttgtgtttagaatgggtttataagcgttataattagaattattagatatagaaattaagagaaatgtagtttttttttttttgtcggtgaatagagttttggttaatagaaaattaaggcgattttaattgttggtttttttatttgaagggggaagttattagtagaagttttaatttagaaattttaagaagaaatgggagggtgtggtgagggtaagcgggggattgtattttttgttttttttttagatggtgttggaaaatattgtaggaaaattatggatatttacgaagaaattttaaaatttattttttttgacgttaagggtttagtttaaaaggtgacgagtaggagtggttaatttttttttttaagagttggggtttgtaggagtttagttaaacgtttgtagggtgaagatagaatttagagggtgatattagtttgagcgggggttagaagaaatagagtggaggagtttggttttatttatagttttgggttagttttgtagtgaggagggggagaggaggggttcgggagggaggaggaggaggaggaggagttggaggaagttttgattggtatttttggttttagtttagtttggagtttagttttttattaaaggtcgtttagtttttttgggttttagttttttgtaaggattgtaagagttttttttcgtagttttgagtttttatttttttggtggagaaaggttgtaaaaagaaaaagagacgtagtgagtgggaaaagtatgtattttatttaaatttaattgaatcgaggagtttagggatatacgtttttaggtttgtttaggggtaagtgtgattttttttttgtttttttaggtttggggttagaaggaaatgtttttaatttgaagtgattttttttaggtagcgttagtggtttttacgtttatgttgatcgttagttttttgtatatgttttaggtttttggaagatttcgttgattttttttttttattttatggtaatgggatttttttaaattggttaaggttatgattgtttaagagtgtgagtatttttttatcgcgtgtttgtggttgttatacgcgttttgtgtatttcgggcggtagtgtgtttcggtttatgatttatttaagttattgtcgttttttaaaatttattcgggattcgttttgtttgtagaagcgtttttgttgaggattagtatagttttttgtcgggcggtttcgttgggagatgttttttgagttttttgggtggtgatattaggttagggtgtaataatttgtatgggttttttgtttagggtcgtttatgggaaggttttggtggagtatatttgttgtttttataagattggagtaattttggtgtttaggattagggttaagtaaagggtcgtttagttattgtcgttaagttttcgtttttttaggaatttgaagtttttattggagattttgttttttggggttgtttaaaggagttgtaggggttagaggagaagaaggaattgggtatttgggtagtatgttgagtgtttaaggtagggtttttggggttgtagggttagtttatgttgtatagaggtgaggttagtgtcgagttgggaggtttcgagggttgttttttggttcggaggatgtagggtggggttcgggtttttttttgttgaggatggatacgttcgttgatagtggttagtttgtttggggaatttgttttaaggggtttattatgttggataatgaacgggtattgaagtatgggtggggttattgggagggattagggagtggttaaagaaaaatttgtttttataggaagttttaggagttagtttcgaggtcggtgtagattttaggagtaaatttttttgagtataggggagtttgttgtgttggatggggaggtagggttgtggtttcggttgattggtttttttttttatatatagtttatttcggcgaggattatagggtgttagagttgtagggtgtttagagtttacggggatggtggatgtttaatttgggattttttagttttttagggttttatttttaatgttgtaaaaaataatcgaaatggttttaaaattaaagttatattgtttttaagtaaaattatattgaaaattgagtgggtggtcgttgatgatattattgggatttttgaggtttttgttgggttaaagataatggaagagatttttggttagaagttattgatgtagtagttttttggtttttaaaatgagtaattaggggttttgagatgcggaattttttgtttaggttagggagcgagtgtttgagatggtagtgaaatttttttttattgaaggagagtagataagttagtgacggaggattttaaataatttatatttcgttgggaaaattgttttgggtttattaagattttattaatgaatcgagaaagaagggaggtggatcgtggggcgggggtatcggtttcgtgatcggaatatcggggttggtcgttttgtttaggttattttttgggggtggagggcgttgaaggaggggatttgtatgtttttttttttgaagtgggtttgtagttgaggatgaaagtttgggtggggaggcgtggtttttataaagattaggatgtaggaatagttgtttgtttggatttttttgtttagggggttttttgttatttagaggtttagtttttttttttttttatttatggtcgagagaagttaggaagtagatattgagtggagtagagggtttgggaaggaattttatgttggggtgaagtgaggttgttttggttttttttatttaggtattggagggtgtggttatagtatttttttgggaggtggttggggaagtttttagaatgttagtttttggtttcgttttttttttgtttggtagggagcgtgttttattttattatagttgtggtttataggtgaggggatatgtggtaaatgtttaaatttggggtttgaatgatatttttgatacgaggtaggtatttttttgaaaaattgtttttattttatattttattttatttttaaagtatttaggatttagtaaattgtattgattttattattagtgttttttgtgattttttattttagaatttaatacgttttcgatgagaaagtaggaagaagtttttttttttagtcgattgttgatttatggttttaatgaggttgtttattttgattttagttttaggaacggaatttatagatttggatgtttaaagttagtttgaaataagatcgttttttttggaagttttggaagttggtagtgattttttgttagcgaggttttatttgtttttttgtttagagtgtttagataattggattaagcgtagtttttattagcggttgatattattttttatttatatgtgaaattttatgtttaggatttaaaatttatcggtaagtcgtgaatattattgcgtgatatttttttgtaggcgtagtaatagttttagtaaaaatttttatttgaaagtttagttttgttattgttttttttggaagaagttgaaaatttgttattttttgggggaaggattgtaggcggtttttatttgatagggatgttgtgtattaggtagtttttttattttgatttacgggagtaaattttttatggtgttttggttgtagtaagtaggtagtaaaaaatatattattgttatataaatagttgacgatttgaggagggatttgatatttaaagaaaattttattagttttagttaagaaaatgaaagtcgtaaattttttaaattttaaagtgggggagttttaaagttttttattaatttagatagttatgaattagataagaatggttatttttattttttcgtttttagatatagtttttttgtttttattgtaaaattttagtggaatttagtgtaaaaatttagtgtaaagaaaggataattttattttttaaataaaatatgttgtttgttttttttaatgtgtggttatgaatgttttatttttagggagtattttataggttttgattttgtagagatattttttttaataatttattttgttaattttgaaaaatataatttttaatatattttggttttatagtttattttgggaaagagatgaaattttgagggttgggtattgtggtttatttttgtaattttagtattttgggaggttgaggtgggcggatcgtttgagtttaggagtttgagataagtttgggtaatatagggagattttgtttttataaaagcgttttaaaaaattaattaggtatggtggtatgtgtttgtaattttagttacgaggttgagttgggaggattatttgagtttgggaggttgaggttgtagtgagtcgtgattatgttattgtattttagcgtttgggcgatagaattagattttgttttagaaaaaaaaaaaaaaaaaaagaaaagaaattttgagttagtacgtttattttggtttgtttttgaaaaggtagtttggtttttttttttttagagggaggtgtatttttgcgagttttagaaaaatttttgaagtggtgtttggagttttttagggtggagttttagggtttgtagtaatttagtgatgattattttagtagagtttgcgggtagttttaggattgatattttaatatatgattgttattattatatttattgtggttgtttataataacggaagtgtatatacgttagagttttgttttttttttttgtttaggtgtaagtgtattgagatgaaattgtgttattaaaggaggtatttttgtttttaaataattgtattataagggtatttagtaaataagatattttataggaagtattttatttatatttaattatagaggtttaaatgaatagtcgggtgtttgagaattaaagtaggtttgtatatttatgttattgcgtatttttgtagaattatcggattttagaattgtaagggtgttcgtgatatgttttttgatatttttttttaataatggataatgggttttaatatatttttaaaaatttatataagttatgattatgaatgtttcgttttgaatatttattaatataaatatatattattgatttttagatttatgtttgttcgtttgagataattagtattaagattttgagggagataattttagtttagagtaaaataaataaataaataaataaataaaaaaaataaaaatttaattttttggttggtttttgtgtttttatgtttatttaagtttaataagatttattgtgtattatggttttgagttttgaggtttagggaggggatatatttttaatgttaaatgacgagttgatgggtttagtatattaatatggtatatgtatatatatgtaataaatttgtatgttgtgtatatgtattttaaaatttaaagtataataataataaaataataaaaaaagagaatatatttttggggaatattaaaaaaatgattaagatatagtttttttttttttggttggtaaatatataatttttgtttggttaattgaaatattaaaaaaattattattttggtggatggtttttttacgttttttatgttttagatgaagaaagagagtttagagaggtatgtttagtgatagggttatagagttagtagtagaattgtttgatgtttttaatatgtagatattttggaatttggatattttaagggggataagtttttaagagtgtattttagggtgttatgtggagaaaggtattttttttatttttagttttttttggagtagttttttttaagttgatttagtagaggagtaattgttgtttaaaaaaatttggaaagaaaaaggagagaagaaaaaaataaatacgaaaagttttgttaaatttttttttaaaggtaaattgttagttttgtaggggtttggttgtatttagtatagtatgattttattgtttttttgaagtttaaatttatgaattatagagaaatatttgagaattgtaagtggttagggaaaagtataatgggaaatgtttttgtaaaattttttgtgtgtgttatatattaggtttttaggaatttagagtattaggaattggttattggaaggaagagtttatggttcggtttaattttaaaattaaaaattgaatagtagttggagttgatttagattttaagggaaattattttaggaaattggttttttatttttggaatttttattagttgatttagtagtttagggtcggtatttagagttagcgttaatttagttaaatttatagtcggttcggcggtgtattagggtgttttgtttttaattggggttgtagaaaatttattatttattagagtttagggtaatagatggaagagagtagtcgtaggattatggtttgttcgagtaataggtaaggagtttttttttatataaaagggaggttgggagagattggtcgattattgttgatagaggtagtaaggaagtagaattttttaggttattgtaataaatttagtatggatgatattttattagatgttttaatttgatttttgaaaaggtttttgtttttaagaatgattttattttttttatttgattataaattagattagaaaatagataaaatatttaatttttttttttataaagagagtattttttagttattttaattatttatagtggaatattatagttttggaaaggttagtagtattttagtttattgttaagaaggaaaagataggaataagtgttaagttttaatttggatttagtagcgttacgtggtaaggagttggaatggagtgggtatttgtgtaatattttttgaagtattttttaatgtattttttttttttaatgttgaaatggaattagtttttgtttgatgtttataattagtagtataagtgtagataaaattttgtttggttgtcgtatattttagaatgtggaatgtgttttatatttgtatggtggcgtttagttttttaaattatattagatatggaattttttgttttatggttattatttgtaatgttaggaatatgttttaaagtaatttttttaaatatttgggtaattaatttggagttttttaattgtttttgtaatgggaaggagatttatttttgaggagtttggtttaagtttggttgtaggtcggtatatttttataggtgtttttatttatagagggagggtattggtaggggatgtttaggttttttttttttgtattgttttgttataatttataagttgtagaataggtgttgttttgttagattttattaggaagagttgaagatttcgaattcgttattttatatttaataaggattttcgtaagtgataaaggattttagtaggtgataaaggaggtttagttattttgtttgatgagaagagttttaaaatgttgttattataggatatatatttagtttgagttaaatagattattgttttagagtatttttatagaatagaaatttaaaggttaggtgtagtggtttatgtttataattttagtatattgggaggttagggtaggaggattttttgagtttaagagtttgagattagtttgggtaatatagtgagatattgtttttattaaaatttaaaaaaaattagttaggcgtggtggcgtatatttgtagttttagttatttgggaggttgaggtgggaggattgtttgattttaggaagttgaagttgtagtaagttttgattatgttattgtattttaatttggataatagagttatattttgttttaaaaaaaaaaaaaaaaaaaagggaaaaaagaaagaaatgtgaaatttaagttgttaaataaatagtaaaaaaataaaatttgttatatttttttggaggttttttggagtttttttaaaatatttttttttgaggatttttttttgggttttttaaatattaagagtatattaaattttattttttttttattttaattgtaggatttaataaatttttttttagttttttttttgaggaaaagaacggggattttttttttaggattcgtgtaaaaagagagagaaagagtgagaaaaagagaaagaaatggggcgtttttttttgtagtttaggaatgggcgtggtaaaggtaagggtggatgagtgttttaaatttattgaaatttgattttttattttatagttagtgtgtacggtttttttattgtggtttttgattatttttattgtttttattttaaataggataattaggaattaatagaagttttagaatttgataggagggataggttgattttaaaaagtagtgtttggagaaaattaaataaatgattttaaaatggaagttttggatttatttgagtttttgtttttaaattatttttttgtgtgtatgcgtgtgtgttttttttttaaaaaagatttttagatatggaaaatgaaaaaggttttgagtaggttaaatgaaaattaatttatagaattgtaaaatagtttgggaaattatatttattggaatatgattgaatatgattttaggttgaagggttatgtagggtaatttttttgatgaaaggtatttttttaaattttaaagggatagaaattaaacggaaaaaggtattttaaattttttttagaatgaggtagagtaaataaaaagatgaataattttaaatagaaagatgagaatgaaaatgtgatgaatgttttttattgaatttgttttttttaggatatagaatttaggatgaaggaatagattttttttagtttaaggattttaagtagttaattttgagttttttttttatatttgaaagaatgatagtagatagtcgatttttattgatatagaatttgtggtgtgttattattaaggaagtttattttttttttaaaaggtatggggagtttttttgagatttgggttaaatttggtatagtttttagggtttttcggggttttttttatgagttttggaaatgttaatttgggttagggttttggttttatgttgtttttatttatgtagttttgaataattattttgttttgttggggttttaattttttagttataaaatggagggaaattagttatcggatggttgggaggagggcgtgaaattttatttataagatagaagtttaggaaacgttattagtatttttttttttttttttttcgggagggtggtgtcggggaatgagcgcggatggttgttttatttttttttgttgaagagggcgggtggttatttggtgagatggtgtttgatattttttaataatttaaatgaaaaagttttttaaaatttgttgttagggaatttcgtttttttataaatggagattttaggatatgataaataatagaagagagttaattgtaaacgaaaatattagtaaatatttaatagttgggttaggagtttacgagttataagatttgtttttcgtatgatggtaggaaagtgtgtggggttaaaggcgttttttttatttgggaatttagtttagttaaattatatgggttttgaattattagtggagtttggataacgtattgttttataggtattatttttcgttttttttagagttggaagggttttttttttttttttttttttttttttttttttttaatatttggatatattttggataaaataatttttgtgtatagtgtatttattttattattttgtgttttaatgggaagtatttttattgagggggttatttttttaaagatttatattttgaaaataaaaatttttatatatgatttttaatgaattaaaagtttattttatttagaatggttgaagtaagtgagtgatgttttagatttttcggattttattttgtaattatttagattgtattgagtattttggaagatgagaaatgtaattttggaattgttttagagtgagtttatttaatgttttatatgtgatagaattagtggatttaaaggtttttattgtgtgaggtatgggaatgattaagaaaattattagtaaaatttgtttaaggtataatttatttgtgttttttgttaatgttttttgtataggtgtttgtagttttttttattttagatttaatagtgaggagatagtttttattttattatgttttattttttttatttggattataaagtcgaatgttttataaagagtttttataatatttttgtgtttttatttataaataaaaatattatttaaaattatgttttttgaatatggattaaatatttaaagtaatcgaattggattttttagaagatttgtattaaaatttttaattgaagtagtgatgtttaaatttttggggggtgaggagtggtataattgttttttagaattatatataaatatggatttttatttttagaaaaatttttatttatagatgtaattttgtatttaattgtgggaggattatagattttttgaatttgttgatttcgtattaaaatattgatttggattagttataataatataggttgttttggaaagaataggttatttttttagaaagaatttagtaggaagtttatttttgttaaaaaaaaattgacgtttaagtttgatagaacgaattaagaatagtatatataaaatgtatttttatattattttgaagtgtatattattatttaattgaggttatataaaaaattagatattgtaattgttttttttttttatttgaagaaatatttaggaatgggtttaatagattgtagggaagaaaggtagagtttggtggaaaagtttggaaggtttttagggttgtatgggtttgagggatttttagagagtgaaggggtaaagttggggttgtggtacggtgggggtagggttaatttaagtggagggaggagaataggtagtttagtttgtcgggggtttttgagttttgttgtgttgcgatcgggttaaagtttgggagtattattaaattatagtataagtattggagattgtttttttatattgtgttaatatatatttatgtttaaaaggtagtgattattgtaagggaaaaaaaatcgggttgagtttttgtaatattgtcgttattattatttattgttgttattttgttgtagaaaaatatttgttttgttgataattggttttttgagtattattagaatagtattttttttttattgttgatgtatttttaagagattgttgtattgataggtggttttattttagttgttgagattatggttttaagtttttagaatttgaattatagggtatatttgttttattataggtggtattttttgttgattttttttggaaatttaaagttatatgggttttggtgtttatttttttgtttgtggttttatttgtttttattttattaatttttggcgggttaggtttagggtttatattgtgtttcgttttttttatagttgggtcgtaagatttggattttagtttttttttttgggtttgattttaggtaggaggaattttacggtaaatttacgggattgagttttaggttttttttgtatttatttagtttttgtttttgattggtagttttaattattttttgtggttttttttgtatttttgttaagtggtttatttggatattagtttgttgttttatttatggtaaagttatattatttattagtcggatagatttttttttgttattaatttttaggtggtaaggttgagaatattagattatttttatttttgattttattagttgtatggggaaaatggaatttttgtgttatataatagataattatgaagatttgtagagtttatgggggtatttgtggagagaggaagattaagatagagatataaaagtttaggttttgggtggagtcgattttaaagtttagaggatattagttaaggtagaagttatgtttgtattaggtttgaatgtttatattagatttttttttatttttatgagattttgattttttttgttaaattttaatattttgtatgatatatattttttttttatttttttttaaattttatttagaagtaagggtaaatattgtgttatttgaatatagcggtatgtagatatattttaggatgtttagttgtattgtttttttttagtagtttttaaattttattatattttaaaaaagagatgttgtatttatattatttttgttaaattgatggttatattttaggggtagttatttatgtttttaaaatttggtaaatgatattttttgtttttatttttattttaattgtggtaaaaattatataatataaaatatattattttgattatatttaagtgtatagtatagtagtgttaattatacgtattttgtgttataataaatatttataattttttgattttgtaaaatagaagttttatatttatgggatagtaattataattgttttttttttgatagtttatggttaatattattttaggttttttttttaagattttgattattttaaatatttttatataaatggaattataaagtaatgtatttgttttttagtgattggtttattttatttagtataatatttttaagatttatttatgttgtagtagataaaaggattttatttttttataaagttgaataatattttttgtatgtggtatgtataagatttagtataatatagtaggtcgtgtatagtggtttacgtttgtaattttagtatttaggaaggttaaggtggaaggattttttgagtttaggagtttaagattagtttgggtaatatggtaaaattttgtttttattaaaaatataaagtttagttgggtggggtggtgtgtgtttgtagttttatttatttaggaggttgagaaggaaggattgtttgggtttgggaggttgaggttgtagtgagttgtgatcgtgatattgtattttagtttgggtgatagagggagattttgttttaaaaaaaaaaaattatagtataagtggtgtaataatagtgtaaagttttaggagaattgtaggaatagtagttaatgaatttaataaatatttattatatatttataatgatatagataggtattttgttatattttgtgtttagagtgtggttgagttttatagttttggaagattttttgtttatgataaagtagttttggaaatttataattaattttataattgtaaaaaattttattgtgtgtgtatatatatatatatatatttaattaaggaagaaaaaaatttgtgtattaaaaattataaaatattgttgaaatgaattaatttttttatttattttatttattgatggatttttaagttgtttttattttttggatattataaataatgttgaaatgaatatgggtgtgtatatatatttttgagattttgtttttattttttttggatatatttaaaagtgggatagatgaattatatgataattttgtttttagttttttgaggaatatttatacgatggaggttagtttttttttattgtgtagttttgttgaagtttaaagattatatatatgaggttttatttttgggttttttattttgttttattggtttatatgtttgtttttaagttagtattatattgattttattatattattttgtaatatgttttgaaattataagtgtgaggttttaagttttgttattttttatttttttattttgttaatgtggtgtattatattgattggtttttatacgttgaaatatttttgtattttagaaataagttttatttggttagagtgtataatttttttaatgtgttgttgatttggttagttagtattgtgttgagaatttttgtattagtgtttattagggatattggtttgtatttttttttttaatattggttttataaaaatgagtttgggggtgtttttttgtttttaatttttttgagaaaagtttgagaaggattagtgttaatttttttttaagtgtttggaagaattttttaggagagatatttggttttgggttttttgttttttttttatggaaggtttttgattatcgatttaattttatattaattttaagtttgtttagaattttttttattgttttatgatttagttttggtggattgtatattttaagtaaatatttattttttttttaggttatttagttttttggtgtgttattttttttattttttatagattttatgtagttttgttagtttttttaaagttttgtataaataattttacgtgtttgatttgtttttatttttttttgttttttttagggaattgttaaattatttttgatgtaggggatataaaattaatttgtaagtatttggagttttagaattataagatgaaaaaagttatattttaaaatttgatatatatttgatatttagaaagatgtttttgatttttatttatattgatgttgaatgtttttatatgttgtaatttgtgaaatagatttttttttaatttttaaattttaatagtgaaatgatgatgaaaatttaatttttttagattatatgtattttagttttttaagttaaatggaatttttaatttaattgtagtttatattatattatttttaatattaaataattttttttgaaatttaatataagaaaaaatgataatattaattagtgttatgaaagtttatgttgataatgagattgagtttggttttttttttgggttttttcggggaaatgttagtcgtttatttattttaatttttttatttggttatagggaggtagtgagttttattattaagggatatgggttttatttatagttaatggagttcgagagagtagatatttgtaaatttagtgatttgggtttagtggaggtttgggtaggtggagatgtttttggttgttgttttagaggagtaagagtttagtaaaattagatatggagaggaatagtttatgaaatgtgtttggggaattttgggttaaattaagtatagtaggtttttttattttattttttagaattgttatatattaaggtatattgtaattgttttagaaggaggtttggtatttagtattttttaaattgcgttgtttatggaatgtttgtttttttttttagaatatcgaatggaatgggtgttttatgaaatgtgttttgggaaatgttgatgaatgaaacgttgttggagaatggtagttagagtttatttattatttatttcgcgttaggtatttattaaataggttattatatgttttttatagagggttggaagagaggtatggttattattgttttgtgttatagaggaggaaatggaggttttgagtaagtatattatttgtttgaggtagggtatggtggatttaggatttagatttatttgattttaagtattttgtttttttttaatatttttggttttttttttgatttttaaaaagtttaaatttaggttggtgaatttgattgaaaagttgttatggaatcgtggggtttttatggagaaataaaaatgttttttttatttttttattttatgaatttttagtgtggtaggtgttattgagtattaaggtgtttgaatagttgtgtattttggttatttattttttgtatttttatttttttttgtaagtatgaggattagtatttatttttaaggataatgtaaagataaataatatatattatgaaaaattatgaaaaattgtaatgattatatagtagatgttgaataatttttgataatatggtatttaaaatagcggtttaataatattttagtttatttgtgtcgttaatggttttgttttttagtattgttatttaaatttttgaaaagggaatttttgattagagagtttttaattggggaatttttggttagtttgggtaagaagagttattgatatgtatattattgtaaaatgaaaatgagtttttcgtttaaatgttttaagaattttaagatagtaatattaaagtattaaattgagtatggggttttttagagtatagggttttgtgggtagtttcgtttgtggtttaagaaaaagttaaaggaaattagaattttgtattaaggagaggagaaaaaagatgttgttttggtaaggggattttagtttagatagaaagattttagttttttggaggggttttaagggagattttagtttttaagttgattttttagattggagattggagagtgaagaggttgttataagattttgtggtaggaagaaaaggtgttggtaggggaaaggtttgatggcgtacgttattgagttgaagtgaatgtgaatttggttggtggggtattatgtgtgcggtttttagaggcgcgtgggtatgggagattttgtattagggtagttagtttttaggtttggttttatagttttattaattaaattattttaggtttattttattgtgagattggaggttggtatatggtagattttttttggaggaaaagtgttaaatattaatagagaatatggataaggtttgatatggttttagttgttgtggttgggttgtatttggtgtaatttgggtaaagttcgttttttttataaattgaaatttttttttgaggtttttttaaatatgatttataaatttaagttgggtgttaaaatttgatgttttgtgtttatgagtgtttttatttttgatttatttttattttgttttttgtttaggaatatgttatttttaaattgttgcgtatattatttagggaggaaaagaaggtttaattgtatagttttttagttgtggttaaagtaatagttattagatttaaaaatttttatttatatgtttaattaaaattattttttataatggataaattttttatttattagtaatttgaaaaagaaagagaatatttttagattgtggagaaattattatgaatgtttattttttaaaaatgtaattgtgttttttgaattatgtttaagaatgtttagagaggagagtgagtagtgttattataggtgatttatgttttgttaataagaagaggtttgaggtttttttagatagagagttttgtttatttattttttatttatttattttttattttttttttatttttttattttgtttttttttttttttttttttttttttttttttttttttttttttttttttttttttttttttttttttttttttttttttttttttttttttttttttttttttttttttttttgttttttttttgtttttttttttttttttttttttttttttttatttttttttttttttttttttttttttttttcgttttttttttttttttttttttttttttttttattttttttttttttttttttttttatttttttttttttttttttttttttttttattttttttttttttttttttttttattttttttttttttttttttttttatttttttttttttttttttttttttttttttttttttttttttttttttttttttttttttttttttttttttttttttttttttatatatgtatatatgtgcgtatgtatgtatttgtatagatttttatttatttatttatttatttatttatttatttatttattatttatttaattgtttattatttatttttttgttgttggtttaaagaatgaattagatataaagtttttttggaagtttaaaaaggacgtagaaagtatgggattttgagagattttgtataatgagagttaaaaattgattattttttttgttttgtttttttttttaggtttatatttggtgtttagataaatttaaaatgaggaaatatcggtatttgtttttagtggtcgttttttgttttttttttttaggtttttttataatttatgtttagtagtagtaagtaggtaagagttagaaacgtttttgattttgtaaaaaggaatattattttttgattttagattttagatattaggtattgatatagagtttagatatgtttttaaggtagttaagttatttattataggatagttagataggatagttttaggatttataggtttttttagatattttttatttagtgagagatgatttatttttattaaaatttgggtttggtattttggaattggtttgaaaatgatttgtttttatattggatgtgaacggaaagtttgtattttaaatgttttattatttgaagggattttttatatttttggtattggttggtttttgagtatataaagtagggagaagttaatgattgagagtaaaaattattttttttgaaaaatataaagattattttttttttttaattttagatgtaggaaggtattttttatttaggatttttgaatttttaagatttttgttttttaaaacgaattaaaagtatgggttttaattaattttattaagaatttgattttagagttttagaaaagtgggaaatgttttatgtattgtaagttggaaaggatttaggtgggtttttttttttttgatttagagagtttggtttttgagggattttttttttaggttaggttgtttttagatggagggaagtttagtgttattttaatggaagaagaacgtgggttggggtattaggttagtttgaggtaagtagagtttagtagtaagtttggtttatagttgtagaagggtattttttggggttattgatagtttgatattttgagtttttatttttgagggagaattgggtttatttggaaatgagatagataatgtttgatatttatggagatttttttggttttgaaaaatatgtagtaattaatagagtatagtttgtttatgtttaaaaaatttggaaaaaataagtttttttttttttttatatttatataagtttttttcgtttaaagaatatgtatttattatatttattttttacgtaaattatttaaagtattgggggttagtgaatggaaaatagtaatttttatttttttttttttgttaaggttcggttttgtattttaaattaaagaatgaatttataaaatgatggttggttgtttgtgataagatttttttttggtttaattaggtgggttttggggtttaaattgttatagggaattatatttgagttaaagatagtttaggaaattgtttttttaatttggagtatgttattggtttatttatgatggtttttgagtatggaatttgggttagtgattgggtattagtagttattgagtgtatgggtttaggtttttggtttttaggtaagtgagtttatttttttgtattattagtgaggtgtgaagtgtttagtagtagtatagtgtaaattaaatttgtttaggaaggttttgtattgataggaagtaattgtttatatagtagaaaaatttaaattaatgtttttttttaaagatgttaaaaatggtgcggttgttgatataatatttttagtggattttttttggattattggagaggaatatttttaatttgttcgagagtttttatatgatgttgtaaaatttttagttgtgggagaaaatgatttttattttgttttggtttagtttaacggaaatttatatatcgagtttttgttaaatacgtatcgtattaaataagaagtttttttttatatttttaatatgttttatattgggggaattaattagattggaaaaggattagaatatataatgtaaagttattttattaaggttgttggaagtcgggtcggtgacggagttttttaggttatcgtagtgttaattgatggatattcgaaggatggttttgttttgtttttagcggaatttaagtttgttgatgttaacgtgtttgtaattggagttgaggatgtagatgaaggagcgttaaaagaaatagtaagtgaatcgtttaatatgtatatgtttaatttagagaattttattttattttatgatatagtaggaaatttagtgttttgtgtgtatttattcgtgagtttagaaagggttggggatacggaaatttttaaagatattataggtaatggtaacgttattaagttacgttttgttttgttgtttttgggagatgagtttggtaattgttggttttaaagtaatagttaggatggcgggtgggttagggaagagatgagtgtttataggtttaaaaataaaggtttgatttggaatatttttttatagttttttttttaagtagggtatttatttatatataagaagagtttttttttaaataattaatatttttagtttaaaaaaatttatattttaatattatgattttataaaatatttttgttttttttagaaaagaaagttttagagtggtgaggtgtgtatttgattaaatttttttatttggtgttgggatttgttttttttaaggaaagttttttgttggagagtgcgtgaattgagacgggagcgagggtatttgtttttgtgtttagtggattagtagagagttttttttttttattttacggagttaatttaagagtgttggtagaatcggaattataagaaattttagttatgatttagtttagattgattttggaaaaaatttagttttgaatggttagtgatagtcggagttggaggttgtgtatttgggttgtgggtttggtttttttattttttttttatgcggtaattatggttgtgtttatagagatttttttaattttaatggagttgatgagaattattttggaagtattgagagtatacggatattgtatcgatgtgttatgtgtagttgtatgtatagagttaattggtcgataggttatttaattagttaagtttgttagttttttttttagggttaagtgtttaaatggttaatggggaaggaatttgataagtataattttaaattttattatattatagtaattgtaatgagtgtttagagtttatttattagcgatgggtagagtagagggatttttttttgttagaaaatgagtttatgtagttatttgatagttggtagtagagaattttgggtggaatgagtaggaaatgagagaggaatttagggggagagttgagttttagaaaggagatatatatgttttttgagatggagggaaggtatgagaaaaggggttgtgtttttaagatatttaggtggataagaggtatattgagagagtttaagttgagttgatatttattattttaataaaggagggaagtagtggggtttgggggtttggagggattgaagttatttttgattagttgttatagggatgtgaagaggggttataaaatatttaggaagtaattgttgatttgaagtggtatttagttgttattagagattataagttagtgggtgtttttattagtgtggatttttgtttttttgtagatattttaggtatttttaggattaaaggagtttttagaattggaatttgtaaagagggaataatagagaggatagaagaaaatttttttagtaaggaaatttagagtggtagttagtaaatttttgaaatagtttgttatggtgttttagttgtatggggagttaatgagagttggaatgggttaggagatttttgaagagttagaggatgagaggttaggtttcggaaggagagttttggagatagttgagtgtgtaagttggagacgttgttggtgtgtagatagggagatttttgagggttaatcgcggggttggaggagtttttaatggtgtttagtgtggtttttagatgtgtaggaattatagagagttagttattgtagaaattagagagggtggtgtttataaaggttgtttatatagattttaaagtttggagatgattatagagtttgtagtgtgaacgtaggttgaatataatgtaattaaattatgtaggaatgttggagatttttttttgtgtatttagtaggtatgaggaagtggataattttttgaattaaaaaagaatgagtgggtaattatatggtataggggaattgattataggaagtaagatttatgaatagattttttttttatatttttaaaaatggttattattaagatggttattgggataggaggtaggaggtgaggtgattgatggagagttagttttttgtgaatatatatggatggtggggtaggaaaaagagagttgaggtttggaggtatatattattttataggattatatcggagggatagtagaagaattgtaagattgtaattagaatgttggagtagttgtagagaagtagtattagatgttagttttttataataaggatttagaaagtaggagttgaagagagatgatttaatattagtagaaaggaattagttgttttgagtaggtagaatttgatgaagaagagggttttagaattagttagttttagggtgttttagaagtttgtttataaaatggtttttttagtggttatttttgattttagttttaacggggttggtagtgttgatgtttttatttgtgggtttgtttttttataggaaagagtgagaggtagtttaaatattgtaaagtgttttttgtttttaaatgataggttttatttttggtattattatataggtattagttttgttaaatgataggaaaagttgggtgtttttaagagtattttaaattaaatatttaggttattaggaaatgataagagggtatttataatgaattgtatttttcgttacgatagttttagtattattaattttttgatttattatatttcggaatatcgggataataataaagatttattaaaaaatagtgaaaggggtttacgtttataattttagtattttgggaggttgagacgggaggattatttgaggttaggagtttgagattagtttggttaatatggtgaaatttcgtttttattaaaaatataaaaattagttaggtgtggtggtgggcgtttgtaatttcgggaggttgaggtaggagaatcgtttgaatttaggaggtggaggttgtagtgagttaaatttgtgatattgtattttagtttgggtgataagagtgaaattttgtttaaaataaataaataaataaataaataaataaataaataaataaatagtgaaagggattagtagagaaatggaatattttttattgacgttttgttatatttataaaaatagttgagtttgtttttatgtttaattattatgtaatggataaataatgagattattatagtgaatgttaaatgaaattattaatatcgtgtgtttttatatagatgataaaatttttgtttttatgttaagaaagtatttttgttttttagtgtttaagttattagtagtattagggtagaaaattaatttatttatgtgttttttttaattaatattattttgtagttttttttagtattacgtttcgttgtatgttttacggtaaaaatataggataataattttaggaagaatagtatatttttgtttatagttttttggaaagttagttagaagagtattatagagattgttaattagttagggttgtttttttttattatttgtttgttgggtaatttttttatagagtgtttttgattataaaatatatatatgtgtaaaatatgaacgattattattgttgttaatgaattttatttaaataattaatttttaatggttgtgtttttaaaaatttttttgttattttttaaaaaaatgaatatatttgagatataaaatttttattttaaaataaaagttaaaggtgatagggaggattttggtattagtttttttttttttgtaaaggatgaagatttttaaaatttgtaaaatatatatataattttgtgttttatataggaaataagaatgggaatttgttttttttaatgaaaggaggtattatatgagttaagaaaggtattgtgtttatattagtgagttcgggaaaagagtttttagggatgttaaaggaaattgtgaattttttttggatattgtaaaatttttttgtagaaaatattatagaggatgtgatatataaagtatagaagtagaaaattagataattttaaagtttttaaattgtgtatagatttgattttttgtaatattaatattggttattggttcgttttgttgtatataagtatatatggtttttgtgtgtttttgaggttttagtttttttgaataataaagtatgtttttgtatgttttattattgtgtgtgtaagaggataatgttgttatttagtgatgataaattatttaacgtgtttttatgattggttattgtagatgtttagttttttataagagaatgtttaaggatttttttttagggtttatttattttatttgtatgattataaattttaatttaaaagtaagttataaatggagaagaaatagtgttattttgcgatttagggattatttttaaaagtttgattgtattgattatatttaattttttttttaaacgttttgatatgttgaggaagtggtaaattttttcgtgttttttgaggttattggtttaggtttgggaaatgttgaggaattttgtggaatttgtggagtttttgtattatgtaatgatgtaggttatttttatggttttttgtgtaatttatattttttggtattatatttttttgaagattttttaggaattttatattttggttgaatagtggtaaatgttttgggttttaattaagggtttagttttatataaaatttttgtgtggtaattattaaaaatataagattttaattattgtagtataataattattttatttattgtattttataagaaggattgtgatagtaatgttgttaggttaatatatttttttatgtaaagaattaatttgtaaatatattgttaggaatttttttgtatattaggaagggaagagggtagtttcgaatttggtaatttttgttttagtttatataatgagaagagtttgggtaagaatgtaattttattagagtagaattttttaattttgtgagataagttttggatttttttttatagtgagaataaaaataattttgttggtataaggaaatattaattttaaatataaaatgtttattgttattgaaaagattagagattagagtgaatggttttatttataatattattattatttaaaaatgatattttgagtgtagttttttggaattttagaatataaatagataagtttaagtttatatataatttttttttgtttttaatatatatttaagttattaaaaatatcgattagaataattgtgtttttttttgagtttaaattagttaaatttaaatattcgaattgatgttgtgaaatttttggttttgatttttagatttttcgatttttattttttttttagggttgttatataatttcgtttttagtattaggttgggaattttttgtttgttattatgggggagagaagaggttttggttagttgtttttttgttttttgtataattttaggttaattttaattagggtttattcgatgtttatggtttttttaggtaattagtttaggatgttataaaaataaggttggataattatgttatgatcggttttatattattttgtttaatattgttttgtattaagtgattgaatatagaggtaatgataaaataaatgaataaaatattttgtttaattttagatttgtatttgagttttatgtaattaaatattatttgagaaaaaagaataataaaaattttattaaagtattttttatatgaaaattttaaatgtagtttgagttttgatttacgaagttgtatgtataaggttattttggtttttaaagaaaagagaagaaataatagtttttgaaggtatttagtaatatattgggttgaggaattattaaatcgtgattttgttttgtagttgtggatttgtataaaaaattattttaattatttgaggaggtaggagaaatgattaaaaattagaaattatttttaaagttttggtaatttatttattgattttttttggtaggtttggtagtggataatttatgttattatttttttttttaaatttagtggaaatttttagaatatgtatttaagattgtttttttagaaaagtgaatatgatgtttggaaatttaattatgaggatggtataaatgaaaaattgttataaatgttttttttttatattatgatttttaagaggttgttttttatttatttagaatgtagaattgaaagagaattttatatttttttattaatatgtgttttgtttgtttatatttcgtgttttttattggtttttaaagaaatatgttagaatattgaataatgtatgtggttatttgttttaatgtttttatattttttgtattttttttttttaaagtataagattttgttgatattattttttttattgatggattaaataatatcggaagtgttaatttcgtagttattttcgatttttttgtaaatttttttgagaaatttttaattggaatttagtagattcgagtgggggtggtttagtttagcgatgagtttagaattatgttttttttggatatttattttattaaggtttaggttttgggtgtagtgaaagttttcgggtttgttggtggggagttggttaatatcggtttcgtttttgatttcgtggtggagaattattttattcgggtagggggtagtcgcgtggaggaaggggttttttaggtgttggtttttataagtgtcgggttttttagtgacgagattcgttacggggtggtagtattgaagtaggttagcgtgtttttattcggttttggagtttaggtcgtttttagggtagagttttagtatatagttatcgatgataatttggtgtttattgtttcggaatttcgtagttttggggatttttaggagaaattattgtcgtatattgttggcgtggtttaaaggtatattgttttgaaatcgttaattattgttatataaggtatgtattttttttttattatttgtgtgggagtggggtgttgtgtgtgttggtttatatagacgtaaggtgggtattagtatgattcgttacgggagaagttgtaagtatttatagtttagtttttttttgatgagttgggttttggatgttatgtttgtgatgttatgtgtgcggaaaaattaaagattaatgagtgagtgaaagtttttacgagagtatgagttgttgagaaagcgtgtttttaaggttaatttaataaatttgttgttttgagattattaaatattatcgtattaattatttataatttagtttttttaaaaatgggtttgaggggtttattatagttttgagaaagttattttaggattatggtattgagttttaaaagttagtgttagaagtgtgtttatagatagagtatttttttaaaagtaaagatggagtgagggtgtttttttaaagttattttgtgttagggtgttgagagttatatttttgaaggtaagaaataatagtgtaattatttgatgaaatatttatgaagtttttttttttttgtgtttgtgaagtgtaggagtaatttttttgagtggtaatattaggatataagtttaaatggagggtttttggtaaaatagttaattggagtggtttaaaaaataaaaaaattaattaagttatataataaatatgtatttaataaatataggaggtatggtgggggtattaggatgtatagttttttttattttttgaattgttttttgagatattagttattttttagatttattaattttattatttaggttaggttaataggatgttatttggtaaattagggatatagtggtttttaatagtttttagaaatatttaatttatttttagtgttgtttatatattgggatgttttaatgagattagtttttgattataagattttattttttattttttttttagagtatgggtttaatgaaaattggtgaatggatatcgaggtttttataagattttgattattatttgtaattaattatttaaatttttttgggtgaaataatatattgttataatttttatttgttaattttataaataaagtttgggtttataagataaatattgtaataagatattgttttatttattgtattaattataattgattaagggaggtttttttttgataaaggagtgaaaataatttaaaaataattattttggagaatatgttattgtatgaaattaagagtagaagattttaaagttttaattaaaaatattattatttatttatttaaggagttgatttttatttaatagtgttttgttaattattagttttagttgttgtatttatgtaaaggtaatatattatatttttttataagggttataaaatttatattgagttagattgaatttgttttaaatgattttaaattatagtttttgttgtaataaaaattataggtagaaagtttaggttatggtatttttatttaatttgtgtattggaattgtgattaggtgatgtagtaagaaaagtatatgtgagtgttgttttttggagaaggttgtgtttggtatttatttaagtttgaaaggttaattttgtgtggtttagtttttgttgtatatagttttttagtttttttttttatttgatgggattataaaattggtttaaattttttagatgagttaatagagagattagaattttgaaaataatgttttgaatgtaaatggatattgagaagtaatggaaatagtgtataggattatatgttcggtgtttggagttgtttatgtttattttattatggtgtcgttttgtgattttggtaattaagaaaataattaagtgaaaatttatgatttgttgaggtttttttgagtttgtatattattggtgtgtattttaaagtatagaagtttagagatttttttatgttttgtagatatcgacgatgtaatatggttgtagatgggaaagttggtttttggttttgggttttttgtggatttgttatgtgattttgggtaggttatgtaatttttttgggtttcgattttttgaatttatgataaaggagttgtattagatgaagatatgtttgtattaggagaagttttaattttttaatgaaaatgggtagtatatgatttttgttttagattttttttagttaagtagagttttaattttttgattataaatattatgtttaatattaatgattaatttgtaaatatttaataaatatttttgattatttggtatgtgttagatattatgttaagtattagagatatggtgttgtttaatgagatagatgtggttgttcgtttgttataggataatggggaaagagataataataatataaattagtgattaggtaaaatattttgagtatgataagttgtattggggtatttaatagggttgtgataggaagattggggaagggaattttagattaggtggatggaaggttttgagaaggtgtggaatcgaaggtagatgagtatgcggagagtagggggaagagtggtttaggtagaaggaagagtaggaggggtggttttgtaataagaaggtatttagtttttttttagaattgttagaaggtagtgtagttggagtatattggatagggagtttgaggtttagattttttggatgtatggaagttggagaagtagttgttgtagggggatgagaagttatagggagtggagtttgtgggttgggagttaatggtagaggaaggtaggttgtgggttagtggtgggggtaggggtttttttttgagggtttttatttttttagagatagatgaggaggttttggaggtagtggtagagggttgagtagagagtatagttatgagatagttattttggaggataggatagttaattttttaaggaggtatgggaggatggtgggtaggtataggttttttgatgggggtttggagtttcgagcgtggtatgtaggtattttgttgtgtggttttttttaggaatgtttattgtttgggtgatgtatgaggaagattgtgggtttgatggaggtttttaggagagtttgatggaggtgtagggatgaggtatggaggaaaatagagagaggcgtgggaggagggttgaagagggttgtgttatgttggtgaggagtagtaggatttttaagtttattttttaataaggtagtgaagttaggttttgtagagttatattaaagagataagatagttgtgtttgggttgatatttatgttaagtggaaggaaatgcgtatgtatttttgacgtggtttatagaagagttagttgtgagaattttaaggtttttattattgggttagaggagatttatggtgtagtttttagagaaatgaaatgattttgtaaagtttaggtgaattgcgttagagttatgaagtaaatataggaatttagttatttttttagttatttaatattttttagtgtttattatatttggttaagtatggttttaggtatattatttgttatgagtttttatgatttgaataaaaattaaacgtaaatgattttttatttaattaaaggggattttgggatagagtttttgggaattagaggtgtattttagggtttttagagttgaatttttgttgggtgtaaggagattaggttatttgttttattagatttagaaggtattttttttcgttggtttatcgggagaatttttagtgatgtagtggtagggggagggaaaacgtgggagggtaggggatgatatttatttttttttattttaagagttgtgttattgttggtatttataaagaagaatataataatttgggttatttggtataggagtaagtagttttttaggttattgttatatgagtatttgtttatttttttgttatgtgtgatatatatagtaaatatatgagtggtagatttatggtatagtatatatggaatttatatgtgtttatatacgtgtatgtgtgtatttatatatatatatattttttttaatggtataaaggtataagttttttagagatttatatattagttttatttgtaaagatattttaaattaaaatgaaggggtagtttagagagatagtatgttttaaattaaatgaaggaaggaaagtttagaatggatgtttataataatgattatgaaatattgagaaaaggtttaatgatgttttgtatatattgttatattagtaggtaattgtgttattgtattaaggacgttggtgtataatatgttattttttttttagaatatagattttgttttgatgttataggtgagtatttagatgaggtattgttgtttttatttggtatgtattagcgatttttattttaggtattacgtttttagtttttggtttaaataattagaaatgaattgtattttaaaaatgtgttttaggttggatgtggtggtttatttttgtaattttagtattgtgggaggttgaggtaggtggattatttaaggttaggagtttgagattagtttgattagtatggtgaaattttatttttattaaataaaataaaataaaataaaaattagtcgggcgtggtcgtgtatatttgtaattttaattatttaggaggttgaggtgggagaatcgtttgaatttaggaagcggaggttgtagtgagttgagattatgttattgtattttagtttgggtgatagagtgagattttgttttaaaataaaaataaaaataaaaatatgttttagaaggtagttttgatttttagaaagtttttttttatttttattttaaattttgttttttttgtttgtttttataaaattaatttgttatgtaatttatttgatggaatatagtaatagaggatttttttgtaaaatagtttattttaggtttaattatttatgtttttttattttttggaatttttgttaggtttttgggttaggtgttgtggttttaatagagtttatggtttttgtaatatgggtagggtgtttgtatatggatatagtagtttatagttattgtgagatagttattttattgagatgtttttgttttatggtttgtttttaagttattattgttatattatttaggatttttaaaaataggttttttgttttttttttggagatgaaattttattttattatttaggttggagtgtagtggtgtaatttcggtttattggaattttttttttttaggtttaagtgatttttatgttttatttttttgagtagttgggattataggtgtttgtttttacgttcggttaatttttgtatttttagtagtgatggggtttttttttgttggttaggttggttttgagtttttgaatttagatgatttatttgttttagttttttaaagtgttgggattataggcgtgagttattgtgtttggttaaaacgtaggttttttaagtgaaaaatgtttgcggtatttgttggttttgatgttgattttttttttatacgttttatgttaagtaattttttcgtttgttaaatgaagatagggaatatagaattgaagagaatagggatgtgtaggtttttttagtttttgtatttgataatgagtattttgaaatgaagattgtgaggtaaagggttttttgagtagatattagtggtttttttaattatttaagtaatgattttattttggttaagttgtgtatttacggtagaagagaatttattgaatttttagtgatagtatataaaataggtggttattaaaattaaatttgtttttgtgtaattattttgtaaaaagtattgattgggtagggtggaaggtgagttagtttttttttagtaggtggggaggtaattataatttatgtgtttattaggataaattttttttggggtggttttgtggttacgttggttatagtaaatgagggtgttttttaaatggagttagttttgttgaaagttattgttgattgtgtttggtaaggttattttaattgttttataatgttgttatttatagttattgaagttaataagagagatatagtttttttggtggatggtttatttgtattgggattggttaattttaatgttattcgagattttattgttaaagttatttagaggttggaaatcggataggattttatttaggtggtagtggtttagtatgtagatattgtgaggtttgaattttattttaatatttatttaataaaaagggaagttataatcgttgtgcggaaaatgaagtttttggacggttcggttttgtatacgggttttgttttagattttgttcgtaataatttatttacgagtttagtcggttatcgggttgtcgaggggatttttaagtttttggtgttgattataggtggtaagtttttagatgaaattagttagtttgtttaggagttgaagagaagtagtataatggtttttgttattgggaataagggtgtcgattaggttgagttggaagagatcgttttcgatttttttttggtgtttattttagttgagtttcgagtcgttttattgtaaggtatgttgtttggtttgttggtattttttaggattttttttggaatttttgaaggtatggtggtgatggttttagatatataatggggtggtttttaggtagggtttttaagaataaaataaaatgaagtgtgtttgtgtttagttaagagataataaatgatgaaaatagtagtaacgaatatgatttattttaggtttttttttgtattgggtttaggattgtatggtttataatgttatgtaatgaaattttatataagaattatatgatttaaattataggattatgggttattatttgtttttgaagtttttggtcgaggaggttatattttagtttttatcgtttgttagatttttgtgtttttttgtttttattggtgatttttgtttagttttttttttattattaggatgtagttttttttttttgagttgtttatttatttttaaatagttttagtttgagttgtttagggtatagtgtttttagtttttaattttttttttttttttcgttaagggattatttttaatgggaaagtatattgaatggttaagtgtggagtttaaatttagtggttttttaaattttttatttaatatgattgttagtggagagttatttttaaagatattatatagatttatgagttaatgagttgaagaaatataatttattgtttttaatgaagagaagatgagtattatagaatgatgtttttttattttgtagattcgattattagaggattgtttgatgtaggtatgatttatgttgtttggatgtatgttttttttttatattttttggttttttatatttattttttttttttttttttaaaattttttttaaaatttttaatttatatttttatagttaaagtttaatttaggatataattagttgtgaggtttaaattatagtagggtattagggaagaaataaaaaataaaattttaaaggtatatggtaaatgtgttgggttaaatatattattttgagaattatattttttatttttgatgtgtataagtttggttaagtttagtaattagtttttttttattttgttgtgtatttacggttttattattttattttgggggaatttttttgttggatgattgtttagtaagattgtgattttttaataggagaagagttttagtggagaatgataaacggggaagtttgaagaagattttaatatgagattagtttatttttgttattttttttagttttaaggaattcgtttttttaggttagtgagggttaattgtttttgagttatggatggaagattttttgtttgtgggtagaggtgagttttagaggatttagttaggtaaatttaaatttggttgggatgagtgatatggattgatgtagtatttttatagtatttatttttagggaaggagtgtttggttttaaggattttgattatttttgttgtttgtaaatattttaattttgatgttgtagttttttttgagttaatttggttttgtaaattcggttattaatatgttttataaatattagttattattagaggaaaatatgtagttatttgttatattttataagatggatatgttttgttatgttgattttttttgtgttttaaatgttggtatgtgtgtacgtgttgtaggtatatatgataaaatttttcgtggttgtgtatgttttatttttttttttgtgttttattgtagtttatttaaataaaagggatattattttttttttggatggattagttaacgttggaaaaattaattttttttatgtgcgcgattttgtaatgaatttagttaatagttttgatattggaaatgataatattcgtgttggtttagtgtaatttagtgatatttttgtaacggagttttttttaaatatatattagattaagttagatatttttggttatttgaggtagttgtagttttagggaggttcgggtttgaatataggtttagttttaagttatgtttatgttaattattttacggaagttggcggtagtaggattcgtgaatacgtgtcgtagtttttgtttttgtttatagttgggtagtttgaggatttttatttgtaagttgttaacgttttgatacgcgcgggtattttgattttttgtgtgggagttagttaggcgaataaggtagagtttgagtagattgtttttaatttaagtttggtgtattttatggatgattttagttttttgttagttttgttttagtagttgatttagtttttaattatatatgttagtggaggtgtggaggaagtattattcgtttagttaggtaaattttttttgttgtcgggaattttttttttttttttagatattattttggagggtagtttgttagtttgaatttaagagtattgtggattgtataaagataattggtttttttttattgaaatagtttgaatggggatttgagatattgtattagtaaggttggattttgtttaaagggtgtttacgaaggaaagtttagaatatttagtttatgttttgtttattttgttttattttttatttagaaggatttttttttttttaatgattgtgaggattttggagttcgaatttagatttggggattatggggtggagggagatagagagagattttttttatatgaatatgttttgggattatttaaacgttgaaattgtatttttatatgatttttaaatgtttaatatttgttgtatttagaaaattatttgttataaaataaataaagggtgtatttttatgtaatggtaaaatggtttttaggggaaggttaatttattattattattgtaaattattatggtggtaagatatggttgtattagatttattagtttgttaatattatatagatgaatggtaagattaaattaattgaaatttaattaaaatagttttaagaattgttttaattgagaatgttatttatattatatattgcggtgttatagggtttgttatttgtgttttttattgttttattataatagattgggaagtattgataaggagtttgatttatatagtagtaatgggtattattgtgggttttggttcgtaattttaaatttaatgatttgattatttaattatagtagatttatggtaatttagttatttttgagtggttgatttatattagttttttttttttttttttagagattgagattaatttttttaagtaaaggtatattaagggttatgtttttaatatttttatttgtaatagtttgaaattgttgtttgtttttttggagcgattgttatttgatgtaagaatataatttagtggggtttttttttggtttgttttattgaagaagtatgatgttagatgggataggttgttttagttattagttttgtaaatatgtattgatttgaaataggatatttttaagataagtggtatgaatttgggttttttttttttttgttggtatagtggttattagatgagttttattaatttttgttgttaaatggtgttgggttgaagtcgttttggtttttgttatgttttcgttttttattgtattttaatttatttttattgtagagagtaagcgagatattttgtttttttttgacggtttagttaattttgtgggttagttttttgttgttcgtgattttttttataagattatcgatgagtttaatgtgaagttagaggggattcgaattgcggtggtttagtatagcgatgatgttaaggtggagtttcgttttgatgagtattagagtaagtttgagattttgaattttgtgaagagaatgaagattaagacgggtaaagtttttaatttgggttacgcgttggattatgtatagaggtatatttttgtgaagtttgttggtagtcggatcgaggatggagtgttttagtttttggtgttgttggtcgtaggaaggttatttgatcgtgtggatgggttagtaagtaatttgaagtagagtggggttgtgttttttattttttaagttaagaacgtagattttgttgagttagagtagatcgtgttgtttttagcgtttattttggttgtagagtcgttttttaagattggagatttttatttatagatagtgaattttttaaaattagtgtataacggagtattagtattaggtatggtagagaaatgttagttgttttgttatttagttttttaatgtatgagttgagggtaggttgttggttattggtttttagatagaagttttttttgagtttataggaaaggtggaaaattaattatttgttggttttagtaggaataatagaatatgagatgtttttttttattttgattttttagttgtttttttaggagaatgagggtgagtatttttaagggtattagattattttatagtaagatatgttataaagatttagatattagtggttaaaatttttttttaaaaatagtttttatggtatgtataataaaagttatattatatggttatattgtatttaaaatagtttttatttttatatttatttaatgtttttatattgttataatttttttattatatttattaaaaattaaaggagtagaagaggtagataattttttattataaattttgtattaaaattttttaattgttaattgatattgttatgattttttatttaatttttttaatttagtgataaaaatgtagtgaagagagtaattttttttgtatgttttttgatgaaaaatgaagattttagagttttttttttgattattgggtttattggtcgttggtttgggatggtaatttcgatatttgggtttcgtttttttttattaatttatttgtgatttgtagtaatttaattgaaattttttatcgataaaatgttagtggttgtgtaggtgttgttattttatgtttttttttttattttaagtttttttttgaatatatttttgaaagttaataatattttttaagtattgaaaagttttaaaataaaaggggtttttatattggtgtattagttttttattgttgttataataaagtaatataaatttagtggttaaaaataaaataggtcgggtgcggtggtttatatttgtaattttagtattttgggaggttaaggcgggtttattgtttgaggttaggagttggagattagtttgattaatatggtgaaattttgtttttattaaaaatataaaaattagttgggtgtggtggcgggtgtttgtaattttagttattttggaggttgaggtagaagaattatttgaattcgggaggcggaggttgtagtgagttgagattgcgttattgtattttagtttgggcgataagagcgaaattttgtttatttttcgatttttttattgtaaaataaaaataaaaataaaaataaaaatttttattatttgatagttttgaaggttggaaattggaaattagtgttgttaagttaaaattaaggtgttaataggttgtgttttttttgtaggttttaagggattttttatttgtttattttttttagtttttaggggttgtttgtattttttgttttttggttttattttttatttttattgttagtagtttggtatttttttttttttttgatttttgtttttatttttatattttttttttaattttgatttttttatttttttttataaggatatttgtgattgattatattgggtttatttggttaattttagggtaatttttttatttttaaatttttatttgaattatatttgtaaagttttttttttaagttcggggatttggatttggatatttttgtgatgtttttatgtagtttatttcgttgatatgaaattgttgttttgatgttttgtgtgagttattaggttgttttttttttagttttaggtgaaaaggacgtggtgtttttgtttgatggttttgagggcgttaggagcggtttttttttgttgaaagagtttgtttagagagtggtggaaagtttggatgtgggttaggatcgggttcgcgtggtcgtggtgtagtatagcgatcggattaggttcgagttttatttgaatttatatatgaataagtaggacgtcgttaacgttgttcgttagttgattttgttgggagggtcgatttttaatatcggggtcgttttggagtttgttttgaggaatattttggttagttttgcgggaagtaggataatagaaggtgtgttttagttgttgatcgtttttacggtcgataggtttggggatgatgtgcggaattttttcgtggtcgtgaagaggggtggggttgtgtttattggtattggtatcgggaacgttgatattatagagatgtagattattttttttatttcggattttgtcgtggttatttttatttttcgttagttggggatcgtttaataggttatttttgagagggtgatttagtttattcgcgaggagttgagtaggttgtagtcggtgttgtagtttttatcgagtttaggtacgtagggaattttttgtatttttatttagtgttattgtttggggttatttgtttggattgtgggttataaggtgtttttaattttgttttttttgttatgtgaagtgaaaattaaaattataggaaaatttaggaatttatatgttttttttggtttcgatgggtagaaatggtagaggtttaaggggggagatgttaagatttatgttttggggtaaattaaattttttaaaagggatatatgtgtagtttggaatttaggattttttaattttgtatgaaagtttttgtttagatatttaaagggaggggtcgtttaattgataacgtttgttgcgtattagttttgcgatttttggtaggtttggttagtagttttttgtgaggtaggaaggagtttgattagggatattttgtaagttgggatatagattttgaaatattggtatttttagagttaaggtgtgaagataattttgattttgtttggtgttgagaagtgttttaattggtaggaaggttatttggtttttatgattatagtttattttatttttttttttttgttttttttttttaggtttggtataataaattaaaaaatggtgggagttttggtgttgagaaggaaggaggaaagatatatttattttttaataaatgttttttaagggttattttttcgggttattcgggtggggggggtttatagtggcgaaggaggtagatgcggttttgtttttttatatgtatttatttgtttgtttttttaagaggagagaaaagaaggaaagttggggaggagcggaggaaggagtaaaagtaagtgaaaggaaattattgtaggatatagtgggtgatgagggaggtgaggatgattatttgggtgtaattgagaggggtttggttttttttcgttggtgtttggggaagagagtagtgtggtttattaggtttttgtgggatgtttttgagtatttatgattaggtaaatttgggtaatagtgggataaataaagtgaaagaggttttttttttttttaattaaggcgttttgtgtgtttttaatataagaaaggaaatgtaatatttttaaaatgtatttgtttgtaggaggtttttgtgatgttgtgttttggttttagattgtcgaggatggattttgggaatattgttatagtgcgggtgtagtttttgttgttaggaacgtatatttttataacgttgtggttttttgtttatttatttttttgcgttttagaatagttttttttttttttttttttttttattcggaggttttttttatattttttttgatttatttgatttttagttggtaattttgagttttatttttttaagaaaatgtaagtaaatttaaagagagttgttttcggttacgttatttcgtggttttttgggtggtttgttttcgtttttttagttttttttttttttatttgtttagtggtattatttgtagtttttttttttgtttttgtgttattttttttttattgtgttggatggttttatttatgataaaatgtattgtttttttttttttaaatattttttttgatgcgttattttttttgttagtagtatttgttttttaaagatttatttatattttaaagtttttttttttttattttttttgagtttattttattttgttatttatttttgttttttttttaagtgttttagttgaggttattttatttgataaggtttttgtttttggcgaagtttagtggttgattttcgggtttttgagtagtatttgatgtagtgtaggttacgttttttttaagtattattttcgttggtgttgatgaggtttttttgattttgttttcgtcgggttttttattttttgttttttttttttttgatgtgtaaatattgaaatgtttaggatttttattttttggatttttaatagtggtgattggtgttaggattttttgtttgtgaatttatgataaattgggcggtggtttatgaacgttaagaatttggtgacgatgaaggtgaagttatgtttatatttgtttcgtaggtgttggtggtaagagggacgtggttttttttatcgatgggttttaaagtgtcgggtttgagttttagtacgttcgtatttttatagagaggttggttgattatttggacgtgggttttgatattattcgggtggttgttatttagtttagcgatgattttaaggtggagtttttgttgaacgtttattttagtaaggatgaagtgtagaacgcggtgtagcggttgaggtttaagggagggcggtagattaacgtgggtaatgttttggagtacgtgtttaggaatatttttaagaggtttttggggagtcgtattgaagagggcgtttcgtagtttttggtttttatttcgtttggaaagtttgacgatgaggtggacgattcggcggtggagtttaagtagtttggcgtggttttttttacgatcgttaggaacgtagattaggaggagttggtgaagatttcgttgagtttcgaatatgtgttttcggtgagtatttttcgggagttgtttagtttggagtagaaattgttgacgtttattacgattttgattttagagtagatttagaagtttttagttagtattcgttatttatttttaggtgagatgggggcgtcggaggttttttttggagtattttttatatgaaaaataataggtttaaaggttatggtatttataataaattaaattaaaataaaggttgtatgtttttatttttatggtttttattttgagatagggtttggttttgtcgtttaggttggagtgtagtggtatgattataatttattttaatttttgttttttgggatttagttaattttttattttagtttttttagtagttaggattataggtttatattattacgttcggttaattttttgtattttttgtggagacggggttttattatgttggttaggttggttttaagtttttgagtttaagtgatttatttgttgcggttttttaaagtgttgggattataggtttgagatatcgcgtttagtatttttatgttttttatgtttattagttagattttattaggatatatttgcgattgaataagttgggtttattgtttatggtatttagggagaatgtatatcgtggtaaagtatgagggtatttttataggagggtggtcggaaggattggggggatttgagttagtggtaggttattttgtggaaggtttaaagaaatggaattgtggtttggattggatgttgttaagacgtggaggtgattttgtagttgtattttaagttttatttagaagtaggatggttttggtatagattggtagagaagagtagttatttttattaattaggatagggagtgtttttgttttttttgtggtttgtattatgtttttttttttgtttgtgtttagatagggttataatgtggttttatttttattttgttttattgtgattatagagtagttttgtttgttgtgggggttttgtgagattatgtgtgtttaataggagaattttaaggttatgtgtgttggattagttttttaatgcgggggttgatttttttttttttaaatagttttattataagagttgtttagtttttattatgttgtatttatatcgtaaattgtttaattgtgtatgaggtaaagggtaggttgaaatgtgtggagtagtaatatataagtttaataaaatagtatttgaggagtatttaaaattttaattaataggaaaatgtggtttattttttttaggattttttgattaattttattgttaaaaatgtattaggttgggcgtggtggtttacgtttgtaattttagtattttgggaggtcgaggtgggttgattatgaggttaggagttcgagattagtttggttaatatggtgaaattttatttttatttaaaatataaaaattagttgggtgtggtggtatatatttgtagttttagttattcgggaggttgaggtagatgaattatttgaatttgggaggtagaggttgtagtgagtcgagattgcgttattgtattttagtttgggcgatagagtaagattttatttaaaaaaaaaaaaaaaaattaaattagttatttaatagaattaaatatttttaaaaatgcgttaatgtaaagaaaatgagttagggtgggtgggggaagttgggtatggcggtttatgtttataattttagtattttgggaggttgaggtaggaggattatttgggtttaggagtttaagattagtttgggtaatatagtgagatttttatttaaaaaattaaaaaaaaaaattttaatgaaatttaaaaaataaaggtataggtatggtggtttatgtttgtagttttagttatttggaggataaggagggaggattgtttgagtttgggaggttaaggttgtagtgagttgtgattgtgtaattgtattttagtttgggagatagaaagagattatgttttagaaaaaaaaaaaagaaagaaaaggaaatagaggaataatagtgaaaaataaaaattttatataaatgttagagatgtgtgagtaaaaaggaaatacgagggtataaatgtttggggagtattaatgtgattttttggatatggtattgtgttatacgtattttgtttttatgggttgagattgcgtagtatgttgggatggtgttgggttttttaggggttttatttgttaagtgatggttttggataaggcgagaatttttggttttagttgtttttttttttgtataataaagatatagattttagtggttttggttttttttggtagtaatagtttatgattttgtagattacggtagtttaagattgatttttaaatgttttttatattttagaaattagtagtaatttagattataatgttaaaatttaaatagagtaaatttagaaagatacgttttggataattttaaatattttaaggagtagaaattgttttggtgtaaaaggtttaatttttaacggttaattttaaaaagttcgagatataaataatataggtattttgggatataattttaaggttgattaggattatggtgtaaggtgtatattaaatttgggtgagggttatttatatattgaatgttttttttttttttttttgatttgtagtagttgagagtgatgttgtagatattgtttttttgatcgatagttttgagggagttaggttagatggttttgtatatattcgagattttgttagtaggattgttcgaagatttaatatcggttttagtaaagtgagagttggggtcgtgtagtttagtaatgatgtttttttagaattttatttgaaaatttatagattttaggtttcggtgttggacgttatacggcgtttgaggtttagaggggggtttttattgaatattggtaaggttttcgaatttgtggtaagaaatttttttgttaagtttgcggggagtcgtatagaagacggggtgttttaatatttggttttggttttgggtggaaaattttaggacgatgtgtttaggttcgtttaggtgattcgtttttcgggtattgtgagtttaggggtaggagatcggaatatcgatagaatagagttgtagattattattaatgattttagattggtttttatagtgcgagagtttagagagttttttaatatagaagaaagaattatgaattcgtttggatttttcgtagttatttttgtatttttaggggtggatatttttttttttttacggttaggtatgtatcgtgtgatttatgattatagagtgtgatattaatattttttttttagttaaaaaagtaattagtagttatttttaataatttttttttttttgggttgtttttttagataatattagaaattaaatattggaaaagtagttttattgaaattgtagaaggaagtatattattgattttttattatttttgagattaattatagttttattgaaaggttttgtagtgttgtattgagataattataaatttattggtttttagaataggatggtatttttgaaattagttagtttatgttttattgaatgtgattttgaagttggtttatgtttattggttagatgtttaatatagtttaggtttttttattttttggtttggtgggattattagggagtatttttttggaagatttgtagtcgtttattttagtttttatttcgtgtttttggttttcgtttttggggttgtaaaagtaaagtggatttttttattagtttatatttttttttgttttttttttaagtaatcgttatgtagatatttgaagtaaattattagggttggttttttaaaggggagtagtatgtttgtttttttagtttattgttttttattaggttgtttgtggtatattttatattttttatattgttttttatttttttttttttttattttagttttagttgtttaattataattaagaaattattttttatattattgatatttagttagtttttataaagtttttagattattatttaaaggttaaggggtttttttttattttttaatttgttttttttagtttttttttgttttgtattttatatatatttttttatttttaggaattatttaaaatttttgattataaaggaaatttttagtggtattttttaaaatatttgagattataaatgttaaagttaggtttttattgaatttttgttataatgttattttgtacgggataattgaagttttttgttattgagtttttatagagtgtgatattaaataatttttttttttttttttttgtttagaggatttattatttatttttttgtatttagtatgtttgggagttgtaaatttaggaattataggttaaagaggtatggatttgagtgaaggttttattgtgaataaattattaggaatgttttattttagttatttaattttattttttgtgtatttatgttttgggtttggaaatttaatttttttttatttttattttaattatttttagagaagaagaaagtagatattgtgtttttgttggatggttttattaattttaggagggatagtttttaggaagtgtttcgttttgtgtttgaaatagtggatatagtttatgaagatggcgattttatttaagtggggtttgtttagtataattttgattttattgacgaattttttttgaaggatttttttattaagaggtagattattgacgttattaataaagtggtttataaagggggaagatacgttaatattaaggtgggttttgagtatttgcgggtaaattattttgtgtttgaggtaggtagtcgtttggattagcgggttttttagattgtttttgtgattacgggaggaaagtcggtggaagatgtataggatgtgagtttggtttttatttagaggggggttaaagtgtttgttgttggagtgaggaatatcgattcggaggaggttggaaagatagcgtttaatagcgttatagcgtttcgcgtgggtaacgtttaggagttgttcgaattgagcgagtaagttttggaaattttgtatgatgcgatgtatgaaattttttgttttggtgtaattgatgttgttaaaggtaatttttattatgtgtatattttttatttttttttgttgatatttgtgtttttttagttgtttggtttttggtgttgatttttggagtttttaggtatttggttgttttatatatttatttatatttattgggattggttttgatatttattttattattatttagggcgtttttttaagataagagtagaagtttattatattttgtttttataagatttattttttttttttattttttaattttttaaataatttagatttattgatttttgtgtttaattatagatttattagattaagtatttgagattagaatatttgatttttaagtgtttttaatttaaagtataaatttggggtgtatttaaatattagtggtgtattattatattaaagttaattaatattattaataaagttgattttttaaaatagtttattatttggtatttaatagttatttttatttttttttgtgagaggggtggatagaattgttttttaaagtttatatatataggattttattttgtatttgagtgcgatgttttggttttttgtttgggttgtttttattgttggtataagtagagttcgtttttttagttttagttgagaatttattatttgtattttttttttttagtttgtaatttggatgtgattttggggtttgatggttttagagattagaatgtttttgtggtttagaagggtttcgagtttaaggtggacgttattttgaatagaattagttagatgtatagggttagttgtagcggtggtcgttcgtttatcgtgcgtgtgttagtggtggttaatacgttttcgggttcggtggaggtttttgattttgacgagtattagttagagatgttcgagaagtttcggaatatgcgtagttagtatttttacgtttttacggaggatattttgaaggtttatttgaataagtttagatagttttcgtcggatagcgtgaaggtttgtggggttagttggtttaggtgttttttgggaaatttttaaatttttattggaaaggaggaagttttttttttaagttaaattttttttatgttttattggattgttagtgtttatatggaaaattttttagttattaattgatttaatgttatgtattgttttttttattttggtagttttacgtaagttttaaaagaattttggaaattagtagtttaatttgaatgagttgaatttgtgattgatttatgtttaattatagtttagttaggtacgttttttatttttatttttttgtgtgtatgtgtgtatgtatgtatgtgtgtatatatatgtatatatattgtgtagatatatatattatgtgagtttgttagggattattatgaagtattatagtttggcgggtttttggaatagatatttatttttttatagttttggaggtttgatattttcgaggtgtcggtagggttgttttttttgagttttttttgtttggtttgtaggtaggggttttttttttgtgtttttatatggttttttttttgtgtatgtttgtgtttaaatttttttttttaaaaggatattagttatattagattaaggtttattttaaagattttattaattttaattatttttttaaagattttatttttaaatatagttttatttttacggtattggggtttaggatttaatatataaattttgaggggatataatttagtttataatatatgtatatatgtatatacgtatatatatttatagatatgtatttatatatatgtacgtatatgtatttatatatatgtatatatatacgtatttatatatatgtatatttatatatttatatatgtatatatacgtgtatatatatgtatatataatgtatttatatatatatatatgtatttatatatatgtatatatatgtacgtatatatgtatgtatatatatgtatatgattcgtagaaattatattttagaaatatgagaatgagataaaaattgtttttattgttattgttgtttgttttttttaaaataaattaagtatttaaatatatttttttattttaagtgtaatattaaagttttgtgaatatgggtaattattttttaatttgggtttttagtttttttaagtgtaaaatgaagggtttgagatagcgagttttttagttttttattagtagtttgtaatatttttttttagtttttttgggatttgatagtttttttatttgtaggtggttatttattttattgatggagtagacggagatttggttgatttatatagagtatttgagaattttcgttaagaaggtaggtgttaaggttttttaaatatgagaagtaaattttggtgaggcggggtgtattgttttgttggagagaaatttttttgttaatgtagcgttttaagggagtagcgttgttttgggagatttttttttttagcgttgtggttttttattatttgtttggagttgtgggatggagttaataaaaattttttttgtatttagatagttttattgttgtgttgtggttgtttaggtggtagaatgtttagaaagtatgatgtttttgtaaaagattatgacgtattgatttatttaattttattatataaattaggaattagttattaataaaaatatattgttttatttttggtttgtagttattatagtttaatatttaataatattatatttaaataatataaagaaaataatgtaagtaatgacgtattaaatataaggtgatagttatgtttattattagatgtgatttttgattatttatttgttttggcgtttggtagtattgattattagaaagtggatgttattatagaagtgtaatttattttaagaattttttatttattagtttattttttttaagtaatggagatgaggttgttattatttgattttggaggtgttagtattttaatattttttatagtatattcgtgttatagagggtttgagtttgagaatttatgtatgaatatattttatggatgttattttttatatttttagtaataggtttagttattgatatatcggaaataattatttagtagagtttaaagtttgagtattttaataatttagagtagttagtaaatttgattaaatatatttaagttaaaagttaaattttatattgaagttttttttaaaaatgtagttaggaaaaaaggatattgtattttttatatgtttaggtgagttgtattaaatgtgtttttttttgtaggagttcgtgttttgattttggtgggttttgaacgagtggttaatttggagcggttaatgtatttggagtttgggcgagggtttatgtatgataggtttttgaggtttaatttgttggatttggattatgaattagcggagtagtttgtgagttttttttatgtttttatatatagattagtgtagatattatattttttggtattttaagagaatgaagttaattattagtaggtgaatggaggtggggggggggttttggtagatagttaaatttatttaatttatttgggaattgttttgttgttataatatatgtgaatttggaaatggagatagtaaatcgttggaaatttagcgagttggaaggggattttgggcgcgttgaggttgtggttttagtattttttttgtttttttagtaacggttttttttaatattattgtagggatgtaaattatcgagattgtttattttttaattggaaattgtgttaagagtatttgaaattttgtatgataaaaataatatgtaggaaaagaaaggttgtttttgggtggagaagtgttttaattgttttttttagtttttttttgtgttaatgaagttttttttgaggtttttttattttttttagggttagttttttttagttggaggtgtgattttttgggtttagattggggatggagtttttggaagatgtggggttgagttgcgaatttagagattttttgatggtagtaatagtggattgtggttatgagaatgggaggaatggattttttttttttttatatttttttgtagggttagaattaggattttttttttagtggaagtaggttgagttagtttataaatttgggatatgggagaaagggaaagtttttggaagttcgttggaagaaagtgtatgtgtttattattagtttagtagatggaaatgtatttgggtatgtttttttttatataaggttaggggttagatgggatgagaatgtagagggtgtttgtgtgatttggagttgagaagtttttggtttcgaggttaggattatttgtgtttgtttttattatggttgttttggaagtttttttttgggttggtattatattttatgatttttattttggttttaaggaagggtggttatggatatttgttttggaattatttttagttttggttatttgttatttgtttggttttgtattttggaattggaatatatgtaagttatagttaagatttgatgatggaaatttttagaaataaggtttagtttgtagtgatattgtggataagatttattttattttggttgttttttatttttttattggtgattttttatttgtatttcgatcgttaggagttgggtttttttgatttcgttggtaatttttattatatcgttagtcgtttagtaaatgttatttggagggattttattttatatcgtgaaatttttatatattcgattttgatttttaaagcgtatttatgattttttgttgggtattttttgagatttgaatatttggtttttttttttttcggtaggataatattgtcgagaaagtttgttgtggggttttttgtaagtgttttgggtagaggggagatcgcgggtttatcggtagtatcgggttaaaggtacggtggttttatttttgtttacgtttgagatgaggtgttagaagttcgatattattttggtggggtaatttttttaatagaagagtgtggagatgaaggaggagacgagagattattttttatgttagaaggaggagttttgaggggtagatttgcgtgttgttttgttggggtttgttttagtgaagatggtttaggcgggattttttttttgtataggataaggggatttgtgttttaatagtttggttttttattttataaaataatgttaaaggtagttggcgtttttgatagtagtttggttgcgaatggtagttggaatttatagtatttgttttgagttagtaggaattaataggtttttttggtagagtaggagttttagagattttgatagagagaatcgtgatatggtgtattgaggggaaaagtagtaatagggaaagttatgttgagttttagtgttgttttgttaaatgaagggggattatagggatttttattgtagagtaaagaagattacgggattaaatagaggattcgattattttgttttagggtatttttggagaagacggttatcgaggttattttggtgatgagggtggattcgtaagtaaaaattgttttagtttttaaaattttattttttttttgatttttatttattgggattgtattgtggattttattatttgtttagttgttgatggttttttttttgggagaaaaattaatttatattttttttaataattttgtttggatgtttaagtacgataattgaagtatgataaatgtgggtatgaagggtgggatttgtttttattttgttttagaaggagggattaattggtttttgagttagagggatatcgaatttgtatatttagtatttattagattaagatatgtaagtagagatgggagtgagttgaggggtagggatatagtaggagattttattagggttttaggggttatttcgttaagggtagtttttggaggggatgttgttggattagattattagtattcgagggttttggggatggatagattttagtagtagggtttatgggagtaatgtttaagatagatatttgtttggggagttttgggattttagattaaggtttagttttgggataggggatagaggggtttacgaggaatagtgtggttattagggtttagtcggtagggttcggttagagaattgggaattaagtattatttggaggagttgttagttcggtgggttttttcgggatttagtatttatagagatatagtgttgggggttatttatttttgttttatagggtagtgttgtttgcgttgttatttttttagattttattttttttagggaaattgtaggttttaggttaggttttatgtaggggtttaagaggttttttggtttacgtagtttcgatcggcgttttttatggtgaaatttgttttttgttgtatgttgtttatagtattttttacgttgttgtaagttcggtagagaaagggtgatgaagggttttagtttgtaaaatgtttttgttttttataatagggtgagcgtggttcgtttggtgtgaacggtatttaaggtttttagggttgttcgggttagagaggagtaaaggtgaggcgtgggtgatggggttgttagcgtggggaggggttaggtgattcgtagtttttttagatgttgttagggagggaggcgttggtttaggttttttgattttagtatttagtagttcgtgattttttattggaaggtagttttgagtagggtgggtttaggagtaggggttgtagttggtggggagtttgagaatggagaaatagttttttgtggaaatatgaagaagttaggaaatttttataaggagagaatatgggttagggcggagggtaggttggtgtttacggtttcggttttggatcgtgggagtagttagggaagggagtggagtgagaggatagtaggtgggttgaaggttggtgaatttgtttttttgtttgttgaagtttgaaggtaggtgttgaagggaagggttgtaaagttataaagttagttttttgttttgggttttggggtttattttcgtcggtttagggagttaagattatttaagtatttagttttagttttagttttaaaatatcgtacgtggtggtgagagaggaatttaaaggggtaggattttaatattatatttttagatattgtaatatttaaatggggtggagtgggggaatagtttttggttttttttgttcgagggattagttttgtaggaaaagttaatgttttttttatcgttttgttttttagggttttcggggatttttaggagagaaggtatgtaagtttggttttgttttataaatggaaaatttttttagtattttttatttttttttttgttagaatagttttttatatttatttgttcgttttatttttttttagggcgaagtaggagaaattggattggatggtttggatggtgaagatgtaagtgattttattttaagtttaaattgtttttggttttgaagattttagaaattaataatttagtttgtgatagaaattgtagtaggtgtgatttttaatttttgtttttggtagggagataaaggattgtttggtttttttggagagaaagggaattttggaagaagggtaggtgtatttttacggtggtgttattatggaaagaatattaatattttatttagggaatagttattttttttttttatatatattaagttcgttttttttaggtagttttttttgattttttttgtgagtgtatttattatatttttttttagttttgatatattatagtatatttttttgtttcgagattatattttatagggtagggattgagtttgttttgttataaataaatttttagtgtttggtataaagtgggtttttaataaatatttatggatttattaaacgaatgaaaaatatgtggaagtgaatttgtttttatggtgaatgagtaaattgtaaatattgttttagttaagatttatgagttgaagaatgtgatttttagggtgagataaaaatggaaatatttagtttttagtatttatttgtgttttttttttagggtgataaaggatttcgaggagagaaaggagaaagaggagatgttgggattcgaggggattcggtaaagatttttttattgacgattttagatttgagtttggggaagagggttgttgggaaagggggatgaaaggaagaattttatttttgaaattgttttaaaatacgttgataaaatatgtgttttgttttttttttgtagtttgggggtttggggagatgtgttggtttttttgttaattagataattatttgtaagttttgttatataaatatttgagaagtttttaaaaatgtggtattagggtattttaaatttgtttttggaaaagagaagagtttgtagttttttttattttgtgtttttgtaaaacgtttaagtaaatgagtagtataagttagtttttttttttagtttattttgtttttgtggttaaggataagtaggagtgagtttggggtatttttttttttggggaagaacgattgtatttgtttggggttaagagtgttttgttgatttcgtgattgggtttcgtaagatttgtatggatgttatttggatgggttgtggtcgaagggtttgtttttcgaagttttgtatgtaggtttttgttaatatttttttgattatttagtttagtggtagttgttttttttttatatgtggtttattttttttttttatgttgtttttagggtaatttaggataagatagttaggagagaggatttaaaggagaaatcggtgatttcggttttatggtaaggtgttgtatatttttagattttttttgtattgagggtaagagaaaggatatatttttcggtttattagtagttatagaggttaaagacgtggtttttaatattgtaacgtagtttaagattagtagtagagttttcgtgaaggaagttttcgtggggaattagagtgatttttgttaagtggggttttttagtagaatttgtgttttttagatatttacggaaggtgtttgttaagttaaaggtttgtagaggtgggagtgtattgaagttcggtgtattttgtaaagtgtgtaattgttttgtagacgggttttttttttgtgaatcgatttttttttttgtaatgttttgtgtagtattttagagttagatatttttttttgtagatgagaattttatgttaattttttttatattagggtgttttagggagagatggagtatttggaggatttggagaaattgggaagaatgtgagtgttattagggttttggggggttttgtgataatttttagtgttataagatttgtttaatatgatttggtgtatggttagtttatagttttgtagtgagtgaatgtaaaaggatttttgaaacggttgttattttaatttatttttatttttataatttttttggtgttttattttttttttttttttaatttttgttttttttaaaaatatattgaatagatatttttaaaaataatatttttgttatttttaaatatcgggttaggtttgatttaattaaatatttaagagatttaaatggaaattttaatattgggggagggagggaataaggggtaagagggttgagggagttgtggatttgttgtttttgtaattatttgtgggtttttggggggatgttgtaagtgaaataaaaaaattagattttttttttttttggcgtattgtattttgtaattttaagatattttagaaatgtttgtagtagaatagttttttgtatgtttaatttttagttttgttgaataaatgttaaagttaaagtgatgtgaatgatttttttgaagttaattaaaagtttttaaggttttcgggtatagatagtatttgttttgtagttgggagaagattagtggtgtagaagtttgtaattttttagaggaaatttaggatgttggtgggtgtttaggggaggtttttgtttagaaatgaatagagtataaaggttgtaagttggggttgggtgttgggaattgggtttttagttacgttttgaggggtagtggttcgttcggttcggtatttgggttagtagagttcgttggggtgaggggtttttaaaaggagcgatttattaaaattaaattgatggattatgggtattattttgttttgaaaatttagaagaaaatagaaattttgaaaatattattttaaaatgtttgagtattatttatttatttatttttaataaattgtaaagatttggattaattgtttggaagtgagtattatttttgaataatgttatataatgaaaaagaagttatataatgaaaaagaagaaatatttattaaatgttataatgggttattataatttagcgtgtgagtagagttaaaatttggttttatgaaatgatttaaaattgagtagtttatataattaattttaattttatatataaggtagaaattggatttgaattcggttttagttacgggtttttgaggatttagtttttttttttgtggtttaatggtttgttatttttttttttaggattatagtgttaggtttaggttaagttgaaatgtgttttttttattgggttttagtatgtttatattttttttttagagttttcgtaggcggtttttggtttgagtaatgtattattgagtgttgttggatttttatggaattttagtatgttttttttgggaggggttaggttagattgttggtttgtagaggagaatagtgtttttttgttttaaattttttatggaaggtggttaagatttttcgttgaagtaggtggtattatagcgaataatggtaaattggttatcgtagattattgggttggtttattggaagtggagagtgaggtttttaggttgatgtagtagatgattgagttttataatagagttagtcggttatagtttttgtaatattaattttaattttgtaaagatcgtttgggatatttataaagttttattttaaatttttttattgttgaggaaataattttgaggtggaaattaatggattatttgtgaagtaagtttatatgtttgaattaaaggttatttttggagtatttaggaagatgttgttaagtcgtgagttttatttaagtatacgagacgtttaggtgtatatgtgtgtgttttagatattttatttaatcgagtgtgtgttgtgtttggtcgggattatttggagaatttgggatttttttttattataattaatgtattttatgattttttagtatagttgggaaggtggaagaaaaatagataggttgatattttttttttatattttttatttgaaattggttgggatcgtgtagttaaaaggagttattattttgtttggtaggtttgtagtaatttttaaaatttttattgggtgattaataggagtagtaaggaagtaaaattttattcggatgagggtggaggaagggtgtttgtgtgtgcgagtttttttagggttgatgaggtgtggtttttggtttttggtacgatgtgggtgtttgggaagatttttttgagtaatcgtagaataagagggtgaagtttgaaagagttttaggttttatgtttagcgttttatgtttttttttatagtttgtgggatttttttttttatagggtggttttggtcgaaggggatttttcggagttaaggtgagttttatgtagtgttttttggagattttttttaaatagtttagatgtcgtttagtttaggagtgaaaaatatttttttttgtgaatttaaagtttcggagatagatattaattaatttagaaagttgatttcgttaaggttaaagatatgttcgtgatatagttttagaaggttttgatgatatttgtttaaggtgttcggggtatagtttggttttatatattttagggagatatgagatattaattaatatgtgtgagatgtatattggttcggtttagaaaggtgggataattcgaggtaggggaggaggtttttaggttataggtagataagagataaaaggttgtatttttttgagtttttgattagttttttattgaatatatagtttattagaatagttatttatgttttagttaggtttagtgaaaaatagggcgaaggaagtaattggatatgtttttgttttttatgagtagagggatgatttttagttttgtttgttttttgtttataaggaatttttttgtgggtagaatgtgagggaggtatttagtttaaaaaaaaaaaaatttggttaggacggtggttgatgtttgtaattttagtattttgggaggttgagataggcggattatttgaggttgggagttcgagattagtttgattaatatggagaaatttcgtttttattaaaaatataaaatagttaggcgtggtggtgtatgtttgtaagtttgtaattttagttatttaggagtttgaggtaagagaattatttgaattcgggaggtagaggttgtagtgagttaagattatgttattgtattttagtttgggtaattagagtgaaattttattttaaaaaaaaaaaaaaaaattttttgtagttattttatttaagaatagaatgggaggtagttttgtttgatgtagtttttagtttgatttttttttttggtttagcgattttggggttttgagatttattttttttttattttttttgggttgttttggttttcgaggttttgttagtcgtttttttaaatagttttttttgtagagtttagagaaaatggtgtttagtggggatttggggtttaagtgtaggaaatatgattgaggtagtagtgtttcgggcgggcgttttttttagaacgtgtttatttatttggttattagtaattcgtaatttttcggtgtttcggttttttgttttaggtttaaatgatttttgttttataaagttgttcgaggagaggtgaggtaagagtgaggaataattgtagaagtgtagggagatagttggtttttgtgtttagtgttttatttggggttatcgttttgattatttgttatttttggaagagttgagttttttttggttgttttttaagtttttggtttagaaatgattgtagagtaaagagttgatattgataggaattattttgatttttttttgtatttttttttattttaaagggtaataagggcggttttggttagtcgggttttgagggagagtaggggattagaggtgtataggtgagtgttttcgtgtgtgattgtgtgttttttgatattttataaattatttaaaaaatgattgggtggtatttatattcggaaagttaattattttaaagtgaataatttagtggtatttggtatttttataatgttgtgtaattattatttttatttaggtttaaaatatagtttcgaaggagatttgtatttattagtagttattttttattattttttatttcgagtttttggaaattattaatttttttttttttatggatttgtttattatggatattttgtataaatggaattatttattaggtagttttgtgtgtgtggtttgacggagtattatgtttttgagttttatttatattgtagtatgtagaagtattttatttttttatatgatggaaggatattttgttgtgtggttatagtatattttgtttatttatttattggttgatggagatttaggttgttgttattttttggtaattgtgaatgatgtttttgtgaagatttttttatacgtttttgtttgaatgtttgttgtttgtatatattttaagtttatttgtttatttacgatttggattgaggtagttgttattgtagttaagataggataattgtgggttttggtggtcgtttttggttagtagaagtgaggttttaggttttgtgggatgggtagatgttatgtagaggttttttatggaaagttattttattagtatttacgatggttttttttttttttagggtttagttggttttgttggttttttagggttgataggagaataaggtatttttggatttcgggtaagtttgttttaatattagttttttttttagttgaatagagggtatattgttaagtaggttgagagagtttttcggatgatgttattgtagatagatttttttttagtttttttttttggtaataaaaattttagatttaattttaggttttgtagtgattggttattttattttaagaaagtaagagtttttttttttggtgttttatgggtttttaagttttaattttgttttttttaagtgtttttgggtggaaattaggggatatgttttaggatggaattttggaaaatttaaatttattaaaatgtttagattttgtaaggtgttttttttttggtttttggagatagttttttgtgtttatgtattttgtatagtgagtgttttaagtttatttatgagtttagtatagaagatggtttttaaatttgttgtgattgtagatgttattttgtaaagtagttattagtaatgatgagtagagatatattgttattgttgggttaggattaggtgttacggaattacgtattcgggttttttttatggttgagatgatattgagggaggtattttattatttattattaaaaaatgattaataaattggtaacgagtttaatatgttgttatataaatgtataaaaatattttatggtggaagtaggtaagaatttgtttagaaagtttttttttagtttgaaagttgataaatatatatttttagacgtttttaaaaaatatttatttaatttgtaattaattaataatttaagatggtatagatgtaaagttatttaaatagttatttagtagttttagaaatatttattaatttgtatttttttattattttttttatgttatttgtgggttgcgtagattgtattatattttaagagttaattttatttattagtttatttatttatttaataggttttaatatgtttatatgtattaggtgtttattgtgagggtgtgaaaagggaggtagaataaagttatataaaatttgggagtttgtcgttttgttaggaatttaggatatgtatattaataattgtaatatgtattaatttgtgaaaattggtattgagaggtaatatttatgttttaaatttgtgtatgttatttttgtgtatgtttatatttgagttcgtagtttcgtgtttagagttgagtgtttgggatttgtaggtgggataggttttatgtttttggcgggttttgatttttatgtaggggagagttaggttttagagattaatttgtttggacggttggttattttattgatatatttttttttttttgttttagggaagcggaggtgtcgttggtgtttttggagaacgaggtagaatcggtttattgggaagaaaggtttgtttttagaaaggtagagtttttttgaggatagggattagttaggtatatatgtttttttttttttttggttagtttgtttgttttttttttttagtattattggtttttattttagttttttttgttgatcgcggtttggttagtggaattattgttttttaataatttttattataatttttattattatttttgttattaattatttttgtttagagggttggtttttttttggttatagttttttattagttgttaggttttttgttttttttttgtttggtttgtgttaatagtgtagtattttttgagttattagagtagtcgggtagtgtttggtatagttttagtataatatggaacgagtagtttttaaatatgggtagtgtacgtatagtggtttagttaattatatttagattatttaagagtttcgattttgattgttttggataatagtaagtttgttgtatgaaggttgtttgagaattttttttttattagttttgagataaattataatttgttataattagttcgaaaagattgtatgttttttgtaaaagaaatgagtttttgtgaatttacgatggtttttgtttggagagtgttttggggttttatgttgggtttaatgtttatcgtttttcgtgttttttttttttagttgttattttttttttttattagttcgttttttatgttacgttggtgaaaaggataaataaaatttttttggatttttttttaggagtttgtatatgaatgttgtaatttagaaaattattttatcgaaattttaaaggtgaagttagtatgttgtagtatttttatttagagtaaaagtatggtttggtattatattgtaagttagttttaggttatagggttttagttatgttttttatgtttagggtgagttcggagagttaggattaaaaggaggaatcgggaatcggggttttcgtggggagacggtaaggttatagcgcgtttggggttaggttgtcgttgattttttgttggaaggtgtaggaagttaggagagggttttaaataaagatgagttttgttttttgtattattggggatacggttggaaatattgaaatttgtttatttgcggtaaattaatttaataagttttattttattggtaggggtagagaggtggggcgggtcgtggggagagatatttttttttttgtgttttttttgatataagagaatgtagaggttaatgaagtttaaattatttttattttaggtttcgtaaatgttttgtaagtataattagatgaagtttttttgtaaagaagtaaatgttatttgggttaaaatggaattggatttgattaggttttagtttagatggaaataattttttttgaatgagatattttaggaatagaaattattattttagtaattcgttttttaaatgttatttaaaaatgttttaaaaatttattaataataattttgtgatgtatatttttacgttataaaagaataaagaaatttacggtttattgtgattttttttaaaaggagttatggtatttaatattgtataaaaggattaggttgatttgattgttttaattttaagtattaaaatatttttttgttttttatttttgtttttttaattaattgaagtttaaaaacgaatttgtttgtattatttttaattttagaagtatagggaaaaaattagattttaaattattgaaggaaatttttttttgattttgtttttagtaatttgggttaatagatttttagttgttgatatttgttgaaaattgtaaattaattaagtggtaatttttatatatgttagagatagtaatgtataatttatatacgtttttttgatttttttgatttataattaatgacgtttagttttgaatgttttttatgagagagtaataggaatagatttgagtatgttggggggaggtgttggaaaggagggggtttaggggtgatgatttggaaggaagggaagggatatggggagggggaatatgatttgggtttgagagatggagtttagtgttttggttttgaagtagaattaaagatttacggatgtatagaattaaagtaattattaagatttttgttaattttaagatttttggggttgacgagtttttgattttatatttaaatagaatttttattaaaagtaattagtagttttttttatgttagttcgttagtgttattttgttacgggagttttttgagtttatcgtttatagaaatggttttgtttatatttggaagataggataggagtaggaagtgtgtttatttttgtattttagtttgtaaatattttaggagtttaaggatttattttttaggggtagcggtagggtagagacggtggttatggtgtgttaggtatggcgatttatagttatattttttttttatttttagggagatgacgggagagacggagttggtagtgaaggacgtagaggtaaaaaagtacgtatttgttgaggattatttaagcgtttttgttgttaggaggttttaaggataatttttgatgtgttgtgttttaaaagaattatttttttaaaaattgtttttgtatttgagtgagtgttttcgtttgatgatttagtagatattttttttttttaaggttaatttattttagatgaatttaaattagaattaagtattaaataatttattttttttttatagggagaaagaggattttttggatatttaggattaaaggtaaataatttttggtcggtgaagtattattatgattttgggatggttttggtatgtttatggattgagaattagaatattttggtattagttttgggttagttatttagttaattgggttattttgagaaagatttttttttttttaaaatatttttttatttgttaagtggaggttataatacgtatttgttttggtgtttatgagatttaaataaaatatgttgtaattaaagtattttgtaagttgtgaaatgttataatttatatgatagtattattattgattaattaaattaagattatttgtaaatattataaatatagtagtaatttattggaaaagtgaattaaaattaattatttggttgttcgggaaaagtgtgatttatacgttttttggatgttttattttacggatttttagtgagattttttgttttaaagtttattgtgttatttttcggttttttttttagggtaatttaggtgaatttgggttaaatggaataataggatttaaaggtattagaggtcgaagggtaagtttgcgtgggttttggttgtaggtgaggaatgagaacgtatgttttaatgtgattaattgttgaggttttgataattattttttatttgtattttggttagggatagtatagggtggaaggaagggaattttgagttttagattaatgtttttagggtgttattatggttgtggtttatggttttttttttgtaggtgtatttttttttttttaatttatttttagggtcgttagtttagtttattttaggtatagtatttatttgtagtttcgaattttattatgggtgattgggaagtttgtgtagttattttgggttatgtttatttagacggttaggtaatgggagtgaatgaggtatggtaattgtttttgaagtttttaggtttgtaagcgagttaggttaaggttatgggttttttagattattggtgttgagattttttttttttaagttatttttagttttgatagtttttttttttttattttttgtgtgtgtgtgtgtgtgataaggttttattttgttgttaaggttttagtttgttatttgggcggagtgtagtggtgttattttggtttattgtaatttttattttttgggattaagcgatttttttattttagttttttaaagtgttgggattatatgtatgagatattatatttggttagattattttttaatggatgtttatttatttttttaaaatggtagagtttttaattagtaaattgtggtttagatttgtgtaaaggttgttaatagttatttttagtttgaaatgtagtttaaaaagaaatataattattttattaatttgattagtgaagatagttaaattagattatttaatattttaaagagttttaaaatattggatgattatttatattgaacgtattagttaatttattgtttgttatttatttttttgggagtttttagtaattatattagtggtttttgggaaagtatttgttttattttagtttggtagagaatataatatataatatttttatagttggtgggggatttttattggttttgttgaggttgtttgtttttaaatttgaatttaagagatattttagtttttttaaagtgagagatttttcgtggtgatggagttttttgggttagattatttttatcgtattttttaattataggagttttaaattttttattttttgatatagttgaataatgtttgttttgttttttttagggaaattcgggatttttagggatagttggatagaagggagattttggttatttaggattagttgtaagtatttatttagttttgattcggttatttggggttgggtgttttatacgtggtttttgaaaattttttattatttgttttgtttataagaaaatgtgttttttttgtatttgtttggttgttaaatcgtttttttgatattatgatgtagtaaagagattttgaattttagagtaataagaaattttaaaaaaataggttttatgggatattttgttatttagggagtattgtaatttgtttttatagttttttggtataggtgtatttgaggtttgtgtagaggagaaattaaagaggggaaatttaaatattttttgtttgtattttgtagaagtagtgtaattatgttaggttttggtttgataatgttttttgtggtttatgaaatttttaagggagtttttgatttgtggttaaattttattagttatgttgttattaggagttaggagggtatttttttatagtttttttaaatttttttattgttaatatttttgtttttttatttgaatttttttatatattgttttttaatattgaaattggtgagttttaaaaaataatggaaaagataatttaggagttggaaaattatttttagaaggaaaggtttagggtttagtttggttgaattagggaaaagaaagttggttaggtgggtttgattgttgtttttaagtaggtgaagtgttggggggagtatattaagttagtttttgtagaagattaagtaggtagaaatagttttttggaaagataattaatggtttatgagatgtttgttgggttgttagggtggtgaggtttaggtatgggatattgagggaagttacgagttagtttttagagtttttcggggtggaatttagttgggatgttttagatacggagggagttagggtagtttaatgattttttattgttttttcggtaggggatagcgtattaagcgtgtgaaagggagttttttttttaagagaagtagaatttagatttaggtttattcgtgggttttatatggattggtggtgagttttttggttttagaatatgagattattttaaaggttaaatgattttttagggaaatatatttgttttagaatttttttttttttgttttgtaagggataagattaggtttagagggagaggttgtaaataattaaggttatttaggggtttttttgttttgttttgtgtatttttgggggttaaagtttgtttattcgaattttttatttgttgtgttttttatttttcgttttttggttttatagggttttaagggtaataggggcgattttatcgatgtaagttgtatgtgtttagaatgatttattaattttatgagtttttgatttgttttttttatatatttttttatttttttttaaagtaatgtgtttttatttaaagtattaaagataaatgtcgtaagtatatgattttttgttgttttataatgtatatttttatattcgaaatttttatatggtagagtagttttttatttttttttttttttgttttttttttagtttgttgttacggtaagttgattttggtgatttttttttaaggaaaggaagttttttttttgtagtaagtatagtttgtttttaattttttattttttattttttatagggtttttggagtgtttcgtttttttaatagaattagtttttgttttagatatttttgagggagttaattaagatattttcggtcggatgcgagatgtggttttgagtattgtgaatgatttgattattgttgagagtaattgtttacggggggttcgggtggttgtggttatttataataacgaggtgattacggagattcggtttgttgattttaagaggaagtcggtttttttggataagattaagaatttttaggtggttttgatatttaaatagtagagtttggagattgttatgtcgtttgtggttaggaatatatttaagcgtgtgaggaacggatttttaatgaggaaagtggttgttttttttagtaatatatttataagagtatttttatagtttagagaggttgtgtttaagtttttagatgcggggattatttttttgttttttataaggtaggaagatcggtagtttattaacgttttgtaggtttgtgttttgtgcgtgttgttggtattttttttttttttggggttttgagaaggtttttagatacgtttatgtttttttgtggttttatgttttatagtttttaaaacgtttttaatgaggttatttgtttgagaattttttttgtgaggtttttaggataatttcgtggttttagtattatagggacgtttatatgtttgtagtattgtttttaggtttttttttatatgttgatagtttttgtcggttagtgatgttagtgttggtgatattttttatttattaataaggtggtgtgatttgtttgttttatttatgaggatttggacgtttgtattttttttgtttttttttaagatggttttttgtgtatattttgagttgtgttttattgtgtattgggtatttgttttttataattggttggtgaggtttgtattattagttttattttatggataggaagattttgttgttagtgaggtgttcgtgagaggttaggattttagtttattagattttgaaatttatgtgttgatgatatttattttagtttttattttgttttaatcggttttgaaggtgaatatttagggtggttttggaggtttgtagttttttagtgaggtttttaaaattatgtcgatttagtatttttaatttatattatattattgtgtaaagttttttttagtgaggttttaagggttagtttacggagaggttaagtgtcgtttgtaattttattaaataattggtttaattgtgtgttttttttttttttttttttttttttttttttttttttttttttttttttttttttttttttgagatagagttttgttttgttatttaggttggagtgtaatggcgtgatttcggtttattgtaatttttattttttagttttaagtgatttttttgttttagttttttgagtagttgggattataggtattcgttattatgtttggttaatttttgtattttttttttttttttttttttttagtagagacgggggttttattatattggttagattggtttcgaatttttgattacgtgatttgtttgtttcggttttttaaagtgttggggttataggcgtaagttatcgtatttagataattagtttaatttttatattaattaatatttatttagtgtagttttggcgatattgtttaagatagatgggtgatgggtaggaaggagtttattcgggagttaggaggttttggtttggttttatattttttttatttatttaaagtaatgtgtacgttatttagcgtttttgcgttttagattttttatttgtaaattgagattggggtaggatgattgttaatgtttttttttttatattggatattttatgtttttattatagtttgtgtcggcgaaagatattgggttattattgttattttttagggtttgttttgtcgaatataggatgatttgtgtatagagcgttgggtttgggaatttagtgttgaagttgggttatcggttatgtgtttttgatggggggatttatttatataagtttgtttttgtgtgggttgagggatttagaattacgtgagttttttagtatggttttaacgagattaaaaaattgtttatttattaattatttgtttatttatttatttaaattagttatttgttaaatgaataattattaatcgtgtgttaggtacggcgatagataggattttttgtatttattgggagtgattttgttatttgttttaattatatttgagagggtggggaagggatggagtttttatattgttgttaaaaataacgataagattaagtttttattatttgttagaggatatattagttattaatatttattatttaatttaattttttaaatgatattattaggaaggtattattttttattttatagttgaaaaaaattgaaatttatttgaacgggatatgaattttagtttattttagtagaataaaatttatgtttttttattatatttagagtttaattttatttttaaatgagaagatatttttaatattgttttattgggaagttaatttattttattgatgtagttttgatttatttttttgttatatttttagatattattgattatgtacgtttttattaaaattgtttttttgtttaaattagattaataatatagtagtggggtatgcgtttgttttgtttgtagggagagattttatagattttttggagaatgtttttacgtgttatgtttgtttgggtaagttgtttttttaataggaagatttgtttagttgtaattgtaaaatataatatttatgggagagtgagagaataatgatgatttgtaaaaagagtttgagtttaattgatttataaagtttcgtatttattagagtaaatattattgtagtagtttttatattaaaaatggattttttaaaatagagtttttttttgatggcggataatttattttataggtaataaaggaggaggtagtttttgtttaagttttgatattagaatttagaatgaaaatattggtattagtgattttttagaatatatttttttaaagagtggtagagaagtaatataattttttattttttttaaaaatgttagtatatggtatgttataaagattttaggttagtgatttgttttatttattaagtattaggtgatagaaattgaaatttggttataattaaattaaggtaagatataaattggttttggttgtgatgttttttttttttttttttttttttttttagatagagttttgtttttgttgtttaggttggagtgtagtggtataattttggtttattgtaatttttgttttttgggtttaagcgatttttttgttttagtttttagagtagtttagattataggtatgcgttattaggtttagttaatttttgtatttttagtagagatagggttttattatgttggttaggatgatttcgattttttgatttcgtgatttatttgtttcggttttttaaagtgttgggattataggcgtgagttatcgttttcggttcgtttttgattttatgtgattattttaatcgtttaagttttttagtagattgatgagttgtgtattttgttgtgggtgttatagaataaataggttgttatgtttttttttagatatttgtaatatcgatttattttgtggatttggtagttggaggtttttttttagggataggagagcggtagggagcgatgtggatatcgatatggtttttattttagatagcgttgagattattattttgttttagtttaatgagatgaagaagtatatagcgtatttggttagataattggatatgagtttagattttaaggttttttagtatttcgttagagtggtagttgtgtagtacgcgttttttgagttcgtggataatgttagtatgttatttgtgaaggtggaattttttttgattgattatggttttaaggagaagttggtggatttttttagtaggggaatgatatagttgtagggaattagggttttaggtagtgttattgaatatattatagagaatgtttttgaaagtgttttaaatttacgggatttgaaaattgtggttttgatgttgacgggcgaggtgtcggagtagtagttggaggaggtttagagagttattttgtaggttaaatgtaagggttattttttcgtggttttgggtattggtaggaaggtgaatattaaggaggtatatattttcgttagtgagttaaacgacgttttttttaaattagtggataagtttatcgagtttaacgaggagtttttgatgcgtttcgggaggttgttgttatttttcgttagtagtaagttttgcgtggtatagtatgtgttttggtttggttttatgttcgggttaggagaagtgtaggaatagttatggaaaagataatcgatgtgttgataggaattgttttatttattgaatagatatatattgatatttgttatatgttataaatgtttttaggagttagagtaagtagggaatatgtagatagtatttttgtttttattgatttttttattttattatatttgattaagcgttatttagttataaggtatttttggtgtttttaatagtttataaatgggtgggtaaatggattaaatgtatatttattacgtatgatataataggttggtatgtcgcgagagaagtgatttttgttaggggtatcggggaaagtttttagaaagagttgttttgatcggggtttagttattagtttcgtgtttggatattattgggtttttgtttatggggttttttttttttggaatgttttttatcgtattttagtagtaaatttatatttatttttaaagtttaattttaatggtttttgttcgtcgtggaagttgttgtttttaaggtttgtttatggttaattcggatattttatttagggtatttattatttggtttgttgattatttatttgtgggtttgtggttttttagattgttttttgaggaggtgtagtttattatagtttttagagtttgtgtatagtgtgtagtttagggttagtataggtaaggtttggaatagatgagggggatttataaagtataaataaatatgtatatgttaaatgtttattatttaaggtaatgttgaggtttatgaaaatagtatttatatttgtgaaggtttggtttttaaaagatttaaagaaaaatgtgaagtaaaggtaattttttaggtttatttataggttattgtttttgttttttaaagattaaaaataaaagttttgtttaataaagtattgagaaaatttgaaaagtagttgtattataatttgatgtttaagagtttagaatttgttgaattttttatttgattttttttttatttttgtttttttttttatgttggataaatatatttttaatttaattatttaaatattgttaaatagaatatattggtttattatgttttatggatttaatgttattatattttatgtttaaaattattggatatagtttgtttgatatagttaatttaataataattatgggttaaataaatgttatgtgatttatttaatttgttgatagattaattttaatttttatgttattagtatgcggtttaattgttttttttgttttttttttttaggtgaaaatgttttttatttgtttttagatattaggaaatagtgtgattggttttaaggggattaatttataaagaattttgtgaagtttggttataaataagtgtaagtgattataattattgttttaaaaattgtagcgttgtagggaatgtataggttttttaattattttttgattttatgggatgaggattttgaaatttagaaaatgtgattttttaaaggtaatgtgggttatgttttttaaataatttgttttattagttagtttttgttatgtaataagttatttaaaatttagtggtttaaaataataattatttatttatttttttatttaatttatttagagatagagttttgttgtgttgtttaggttggattgtagttgtgtaattttggtttattgtaatttttgttttttggatttaagtaatttttatgttttagtttttcgagtagttgggattataggtgtatgtagttatgtttggttaatttttgtattttttttttagtagagatggggtttcgttatgttgtttagttttgtttagaatttttgaatttaaatgatttgtttgttttagttttttaaagtgttgggattataagtatgagttattgggtttggttaataattatttatttaatttgtaattttgtgggttagtaatttttgtttgggtttaattgggtggtttttttgttttttttttggattttttatgtttgtggttagttgtttgttagttatagagttgttggtttagagtggttttagatgggttggtttatttttgttttatgtggttttttatttttagtaggttagtttgggtttgtttattaggtgatttggtagggttttttgagagaagataagtgtgtaaggttttttgtgatttaggttagaattggtatattgttatttttgttacgttttattgattaaagtatgtttaaaggttaatttagatttaagaatggaaaattaggtttgatggaaggatttgttatattatattgaaagggtatgggtagagagaaggtagataattgagattatagttttaaataatttatcgtatttggtgtgaaatgattacgtaaaagaaggattggatatattaaaaaatagattttatgtttttttaaaattattaatgttgtgataatatgtaatgatggtaataataggaagttatgtgtatgttttatgaagattgacgggaggggtgggagtgggtaggattgtggtatttatgtcgatgttgttgtttggtttatgtgtcgtgttttatgttttgttttatttcgggtgttaattttaggagtaaagagggtagtgggggtatgtaatagagggttagttggggtgatgtggttgtaagaattgagtttttgtagcgtgttagtaatgtgtgttttttaagagaatgttatagtgtgttatgttttggagggaagtgtagattttgtagattttgaatttcgtatatagatgagatgtgaacgtaaatgatttttgaaaaatgattatttggtttacgattagttgatttttaagatggggaaagagagtttatttttttttattgtagatttttttgtttattattatttaagttttttagtttttttttttgattttagaaggagtggttttaaattttagtatagtaagaatgaatattattgttaaggttattaggatttttatcgtggtattggatgttttatttagttttgtagtttttatttttttaggttttaatgattcgtattttttttttgaaattttttttgaaattggtttaatttttttatttttaggaaaatagaatgaatgaagtaatttagtatttgaagttttatgatattaatttgaaaatatattaatattttttaggataagtagtaagatatgattataaaataatatatttttttttaagattaagaaagttatgaagtgtgggtttttgttgttatgtttgtttgattaggttgttattttttttagatattggtaatagattaagaaattgtaaaaaaaaatatatatatataaaaattaagagaaataaaaaatatatatatttttagtaataagttttgggagtaaaatagtatatgttaattttataattttttagtttaatatagtatttgattgagtggatatttttttataatgtaagtagttaattattgattttatttaatttttggtgtatgttttggttggttaattgttataatgagaatattgttggatattatttattattgttttttattttttttttgtttttattttagaaattgaaagatgtttttgtagaataatataagttttatttttaatggttttattttttaatatgttgttttatatttttttttagggaggtatagatttttaaaagaaggaatttaatatatgtattgttatatataatttataaaaattattgtatgtattttgttaaaataaatttaatgtagtttatggggttatgtttttatttattttagatagtaggtaaaagtagaggtaatatttaatttgttttaatagaaatgtttcgaataacgttattttaagttttatatttaatttagtgacgataacgaagtcggtgattacgacgaagtcggtgattattataataaagtttgtaattattataataaagtttgtgattattataaattagttatttgtgaagttagtcgttgtaaagtcggtttttgcgaaatttgtggttgttaagtttgtggttataaagatggttattgttagatttttagtggcggtgaagttagtaacggtagcgaagtttgtagtagtaaagttagtagttgtaagatttttcgttgttgttgttgtaaaattagtggcgattaagtttgaggtttttaggttataggtagttaaattagttgttattaagttagttattattaagtttatgggtaagaaagtttttgttagggttgttattttgtgatatttttattttttgttttagggtgtgttttttaaagtttgtatgtaatatatttagaatatagtttttgatttgggtttgtatatttggatgatgtattttaagaggtgttggttagggattttagttttttattttttattttgtgtttttaattttgttttgcgatagggatgggaagtttttattttttttggaatgttagtgggggtatagtttattttatttgaaaattgagttgttttaaattaaagggaaaagttttcgtgttgaaataaggttttagtttttatttagggagtgagagagatagaaagaaaaacgttgtagttggtttttaggtagtaaggtagatgtttttgggttggtgtatggagtcggattcgtttattttagaatatgttttgaaaaggtttgggggagttttttgtaattgtaaattttgtttttgttttatatttatagaaaaggggttttaagttgtgtgttgtggtaatattgggtgtttagtttagtagtttgaaaagttagagtttggattattagttattttttaaggtttaaatttatgtttatgttgattatgagaaaaatattgaaagtaatggtaaaaattataatgattttgtattaatttaatatattttagattgaattagatataaaaggtagatggttttaatgagattaagagtatgttattttattatttttttaaagaagatattggaagatattatcgaatgttataagttgtaaaggaaggtttatgataaaatggaaattatttttatttgatgaatagtatgagagagaaagtagaatttttttaaaagaattttatgttatattttaaaattttatgatttaatatattttaaattatggggtttattttgtagtaaatataatttaggattagtatgttgtatttttaaagtatttttttaataggcgagatttttaatagaaaaaaaagttgatgaataatgagattttttattattgtgaattttatattttatgtatgttgatagattataagagtaatgttttttaggggtttgaataagaaattagtttttcgttttagttaaattttaagttaatttgtttgttaatatattttttttagattttttttttcgtttatgtattatagttatggaggattttattttttatttttacgttttgatttattttttagttaagatgtttcgtgaagtttaggtgtttgagataatagagaatagcgttaaattttattgggagagggttgagtttttcggtttttatttttatgattttatcgttattttagtttatgattagtttttggttttgaagtagaattttacggttacggatcgcgttattggaggtttgttcgttgggtagatatattatgtggttgtggtttgttatttgaggttttaggttagagttatttattacggaagttttagtataagtaagtatatgattagtataagtcggtatttgatttttatgtagagtattaaataggatataaaggagatatttatttattgaatttattttgaaataattataaatttaaaaaataataatagtaataataataaaataatttagtttgggtgttttggtggtagtttaagtttataaaatatagaatggaaatgggattttatgtgggatgtagttttgttttttgggttttgggttattttttggaggaagttagatttacgtcgtttgagtatagttttttttaatattgtattcgggaaagatggttacgtttttcggtgagggtttttggttgtttattatttcgtttaggtttttatgtttaggaaaatattagttagttattggttttttagggagtaatggaggtgtttttgaagttttatcgtttcgggggtggaggatgtcgatagttgagtttttttgttttgattttattatagttgggttttgtttttggttggttgttgtttttaggggtttttttattttattgaggtttgtatttgagtgttgttatagttttttttaattatttatggtttttttttttatttttttaaatttttttgggttttttttttttattttttttgatttttattgttttaggaatgtgaagggaaggttttttttttttttaggttaatgttatttagattaaggaattagtttgaggaaagggaatttttattagtgttatggattaggtttatagagatatgagtttaaagatttagttaattttagggttttatttttttggatagtagtagaagaggttgtttgggaagtgagaggatttgtttagaagtttagggattttttttcgtcgtttattagtttatggatttaatttgtagtttatagtataagtcgtggatgtagaggtgttttggatttgtgttttttaattattattttttaatataagatattaattatagtaggtaattttatattagttattaaggatttttaagtttttttgtttttgatttatttacgagttgtatatattttttttttatagagaaattttagtttttatttttatagttagtaaggttagtttttagtttaattattaatttaatggtgagtatagaattattggtttttattgaaataggtgagttgtgaaattattaggtttattaatggtattaagaaaatatttattttgattttaatttaattttttgggttttaagttttagtttaggtatgatttttatgggggaaaaggtttacgttagttttgtgtagtttaatattattttattttgtataattttaggtgtaaatggagttttattttatttgtgattagatttagtgaaaatttgatgggaggtgtttttggggttattattagaatttacgtatttattagatattttttttgtgttttatattgggattcgagttgatttgtggtttgtgatgttgtgaagattggcgttttatttatttagtgatttaatttaataaaaaaattgtttagaagaatataagataaatttggttggaatttatgaaatgtatgggtttggatttgatttatggggtgttttggttcggatattttaagtatatattttagtttagtgtgtgagtttgtgatattgttttttatgtgtttgaattttagagtgtgtgtatagtttatgttaagttagtgattggttaggtgtaatttaggaattgatagttgttatttgtttttgtttttgggtagtgaaattttgagagatttggaattttttatttagtagaatgtggatttggtttgtttatcggtgagaaattgattattaaaatagttgataggttttgtttaagagtgtttagtaaagaatgatggtattaatataaaaaatggaaatgttatgggaatttagatataatattgttttatatatttgaagtaaaagttttttgttaattaggggataatttattattttttggtgtatcgtttattgttaggaggaggaaagtatttttttttataatgtttatttttgtaattgattttaaaggtgtttgttgagtgagtttgttaggcgattttattatggtgtttgagtttaaagagaagttataaagaatatagtagattttttttaaaggtgtgggttaggatagatttaattttaattttaaagttgttgaaatttgtgtatgttattttttatttattggttaatttttttttgaatatagtgtgggaaatagaaaaattttagttaatttagtgttttattgagagaaaaagatttggagtaaattagagattagagattaataatgagtaaattagatagtaagatttggggatgtttttgatttttttatgtgtggtttaaaagggataagattgtataaatagtgtttaatttatataaataataatgttttttagtaagggtttggttgggttgttttgtttttttttttatatatatatatatatatatatatatatatatatatatatatatatatgtagagagagagagagagatggggggagagagttgtgaggtttagaattaagaaggtgtttttgatttagatttttaatattgagatcgtttgtttatttgtgataaagagaaaagagtttttgaaattggggtttgtgttttttttaaggttgtaagtagttgatatagatgaatttaaataaaattttttttttttatattaattggggtataatttttagatttaggatgtgaatgtttttttattattttatgtgtgtgtgtttgtgtatgtatgtgtgtatatatgtatatgtgtgtttttttttttagggtgaagatataaattatttttttttttttttaaaaaaagaataaggttttgtataattgatttttgattttttaaatttaatgattttatagtaataaataagtatttaatttgttttggtttgatgaatatatgttggtgtatatatagttatggtatttttgagagttttttttgaattattaggttggtgcgaaagtaattgtagttttgttattgatagtaatggtaataattggaattattttcgtatcgatttaataaatgggatatttatttaaaaatgtttaaaatttaaaatggataattagaattaggagaggaatttttattttttttatttttattaattttttttttttttttttttatttttttttataattgttattttaattattttttttggggtggggggaaaattttttaatggtttttatatatttggatataggaaaaggagtgataatgaattattttttattaaataattaaaaaaagataataattgtatgtttatttagtagttgtatgtatattttgtatttaaattttaatgattacgatatgtattatttttttaaatatatattttttagattatttaggtaaaatgaagttttaaaaatatattttttatatttatatgtgtttatttttattttttttattttttgtagtatttattaattagaaatatgtttatagagatgggttttttttttagtattaaatagtagatgttattgtttgtttttttatttttgtgaataaaagatgttgttttaagaatttgtattttttatagtttattatgttagattttgggaatttggtgatttgtgtttgaatttgtgaaggaatttgtaggtagaaatattttgaaatgaaaaggtttttagttttgggtatttaaggtaggggaagaggagaggattagtgttattattggttttcgtttgtatatgttaatgtttgtttattttgatagttatattgaatagatgtttgtttattaggaatgtgagttaggtatgtaatgcgagggtagtttggttggggtattttttgttttttataagatttggttttgtttggtatgtggtagggagattttcgtttttgagatgaaggttgattttgttaataggttttgattttattaatatatttagggtatcgttagtaattatttaggattttagttttataatattatatgatttgatttttagtggttaatatttgtatttttttaaataaaattaaatgaatttttataaaaatattttattttattttttgttttgttcggtatttaaaagaattatgttttagttatttttttgttatatatttgttgtttgtaaatggtagtgagtagtagtggattttttattcgttatcgtggttttttgaaagtatgggtgtgttgggtttttttgttatttgttttgtcgttgttgattttgatagtgttacgtagttgttaattttggttttaggtttttgttattattttttttttttttttttttatttttagttaaggaagttttggatagatattttttatgtatattattattaaagttaagattgtttagaatttttaaataataataataataataaaaatttaatttaaaatttattttttgtagtattgtaaaatgaattttaaattattggtttaattatttgtgttaaagaagttttaatgtagaaattagataaaataattaataaaattattatgttttttattatttatttttgaaattagtaatttgtagaattgattatattttgttcgagtagatatgattgggttaattgtatagttttgaaggaattattattttgtgtttattaacgttttatttattgattttaagatgtataattttttttttattgggatatttttgaaattgaaatgtgatttagaattgataatatattatggtttattggtagtattttgtgttatttagtggaatataaaataatggtgtattataaaattaagagtttttatattggatataatatagtatttggttggttatgttttatgtgaatatatattattaattagtataaaatggtatatttgggggaaatatttgattttatgttaataataatttaaagaataaattaattttatagttgaagtaagttaaatagttatagggatttaggaaatggttttttttaggttgtttgttgtttatcgttgtgtgaggatgttttttggttagttgttatgtgtgggttatgatgagtttaaaggagtgttttttattttgaagttttaaaaaatagaagtttgttggttaagatttgaaagagtaaaatttaattatagttatattttaaaataaagttaaaaattggtcgggtgtgatggtttatgtttataatttttgtattttgggaggttgaggtaggaggattatttgaggttaggagttcgagattagtttggttaatatggtgaaattttgtttttattaaaaatgtaaaaattagttaagtatgatggtttatgtttgtaatttagttattgaggaggttgaggtaggagagttatttgaatttgggaggtagaggttgtagtgagttgagattatatttttttattttagtttgggtaatagagtgagatttagtatttaaataagtaaataaattaagtaagttaaaaatttggtaagtttttttggtattttttgaattgattaatgtttaaaatgtagacggcggaaagtgtttttatttaggtaaattatatttgtatttaaggtatggaagtattttatattgtaataataatgtcgagtgagaaggtgattgaatttttttgttttggggattattaaattgatgaggaatatgttgatgattgtagtataaatattttttagtttgtttttttttagtttgtttaaggaagtatttatatcgtgatttggaaattaatatgtttgggaaatgttaaagttgatgtttttaaaaatgtattgaaatattatgggaatattaaattatgaaaaagataagattttttaattaatatgttttttattttgaagaatatatatattttttgttgattataaagttaatagatatgtattgttaagtatttaggaggtatagagaaatatattatacgatttttattgtgatagtattgttggtttttgatgaaaattaatagtgattcgatgtatagtttttttatttttttttatgaatattattgtttgtgggaaggtgtatgtatcgtatatgtatatttatttttgtatattattattataaaaatggattgtggggtttagggtgttttgcgttttagtgtttttgaatggttgtttttaggatgttttaggtaggtatttgtggtttttgggaataggtgggatttttagaatagggttttaatttaatattgtgtttgtttttatttttttttttttatttggttatttttttgaagtttagtgattaatagtaaggaagttttagtagatagtggtttgagttaggtagttttttttttttttgttttttaagtaaatttagttatattggtattttaggttaggaagtcggggaaggttgtggataatttttagtttttattgttttttaggtttttattaggtttttaataataaagaagagtaaattaaggaagatttagttatgcgttttttttatataaagagaaggttttagttttttataggttatatttggggggtagattgattttagagggaaaagatgaataattattgtatttaaagacgtgtcgttttagggaaaagtttaggttaagtttaacgagggttagttattttttttggtattttaggatatttaaatatttttttttttttttgttttaaaatagttgttttaatatatgtatttatagttgagtagagtttagttaaaacgatatgttttagaagttaagattatgtggagtttgtattagaagtttttttaagaatataaaatttttcgtttttatgttttagaagtagagaagtataggtttttgtttttgaatagtgtcgggtttttattttattaatatattttttttggttttttaaatatttttttgtttatagtaatagtgtttttattttttattagtaaattttatagggttttagtagtgatttttattgaaataagggtagaaaatattagtgtcgtggtgtggaattggagggttagggtggagggttaaggaagttggagaagttaattagacggggagtggagtgtgttgttgtgaggttatttatgggttgggtgttcgtggttttgggtagatttttcgtgattggtttagtagagtttaggggattgggaattgaatagttaaatatagatggttaggattgaagtgtatttgaaataaataaaatagagtaaatagggtttattggttaacgttttgggaaggaaggaagaatagggagattatttgacgtcggttttacgttaatagggaagttattagtaaatgaggaataaattttgatggttaaattattttgttttgttagttttttttaggattttttttgatagttaggtatttttttttagttattggtatatttgagagaaagaaggttgtttttgtaaattgtttttattttattttgattttttggagtttttaaaggttttcgtggggattattggttttttgggttttgagagcgtttgtaattaggaggtgttgtaattgtggagttattagttattagtttggaatttgggtgatagtagtaattaggaaatgttttagattaattttgagttttagttttgtgtatttttgagtttggtttatcgtgggtgatttaagttatgattatttattgaagatttaggttttttttgttttttttggtatttatttgaagtatagatgtttattattttcgtagttgtgagtagtttgtttcgttggggataaaggagatggagaagtatttttttgtaggggagagttggataattttagtttgttagttatttataggaatatgtagaattattggttttagggagttttggagaaagaaggtttacgtttttaaatttatagataatagttgatattaatgttttttttttttagaataatttggagtttgttagaaaattttgtaaataggagtcgtgttgtgtgtgaattgtaaatttttttttttaggcgtcgaggggatttttgttttattttgtagttgggttatattagacgtgtgtattggaaatataaatttttttaattgggaaaagaatgtttttttgtttttaaaatagttttgttatgtgatatttttgttattatgaattttatattagtgttagttttttgttttacgtgttttatttggtaggttataaaggtttttggttattatatatacgtgtatatatatatatatatatatatatatatatttataaaggatttttttttttgttttatttttaatttttagtttatttggtttgtaatgaaaggtagagttttatttttgaattatattttaatagaatcgaatttttattttgttaagaattataaaattttgaggttttaaaatttagttttttttttggggatttaatatggaaggatttggagggtaaatggtttagtgattggaaaggggaaaaataatttattttatttaaaattatttaataattattgttagtatttgggattttgagtgttgtttatgaagtttttttattgatataattttatttattttttataaggttgtaagtaatttttatgtttatatggtagtgaggaaatggagatttgagtaggttaagggagtttttatttggaagttttttttttttttttttttgttatagtagggttattagattgttagttttagtattgggagtcgagtaatacgtatgtttttattaatattttttttttatgtttttattaaagatatatgtaagttgtcgaaagacgaaggaatttgtagggattttatattaaaatggtattatgatttaaatattaaaagttgtgtaagattttggtatggaggttgtggtggaaacgaaaataaatttggattatagaaagaatgtgaaaaggtttgcgtttttggtaagtgatttttttttgtgtttatggtttttgtaaataagagatttaggttaataagttattttgaaaaatattagaagtgtaatgattatgatatatgtgaaaaagaagataaagtgtatttttagataaggaagacgtttaaatataatttatgaaatgtttttttgaatttttattttgggtttttaaaaatatattgttttttgttattttttagaaatgttattaagttgttgttatttgtaaaatattgtattaaaaatgatttttgggaagataatataatgaataattatagataacgttaaagataaataatttttataaatttattttttaaatagttttgttttttataaataataatgttgttattggggttatttagtatttttattatattgtgtagtttaattggtaataaaataaatattttgaatagagtttggggttagtgttagaatggggagagtttagttcgtataaaggtttggtagatggtgtagggtaaaagaatgggattagattttttagatatttttgggtttcggggttttaggttaagaacgttatagagggtttttgatggtattgagtagaaaagtgggataggtgatggaaattagaggttgcgggattgtgttatgataatgatagtgtttttttgggttagtaatgtggtttttttttttttttttcggttttttattttattttatttattttttttttcgacgtttagtgttcgttaaattcggagttattagtgtgatgggaatttaagcgtgggtggttaatattatatattttttgaagaagaaggagttagttatcgttaatttgtttttgtagaagtttcgggtgtagatttttttgtattgtattattttatgttttgatttatattcgaattcgggagggaatattttgttgtatgatttattagtatggtgttaatgtgtttgtggattttcgttttttgtttttaggtagttttttcgaatattttgaatgttgtgtaatagttagttattgttggtgtttatgtgaatatttttattaatttaaattttttttggagttttatgttatgtttgttgtaggtaaatgtaaagtttagaaaataatgtaaatgttacggttattttatatatttttgtttggtttatttttttttttttttagttaagtatgattttagatgggaagtttgtgtatcgtggagaaataagagattaatttttttattttttgtttttaattttttagattagattttaagttaattttttttttttgaagtttttaataaatgatttagtttagaaggaagtaaaattttttaatttatgtgtatcgttgggattaatgttttaattaaagaatttaaaaaagttgtaatagagaatatttttggtatttttttaatgttgtgtgttttttttttgtgtgtgttggagggaggggatttaattttaattttaaaatgtttaggaaatttatataaagaaattttttaataaagtatattgaaagttttttgggtgtgacgtttttggtagttttgtttttatagtagcgattgttagaattatttttaggttggggaaattgggtttggttttggttttatggagttgtgtaatagtttttcgtttttagtggaggaggtaaaagagttttattagttagtgtgtaaagagatcggttggagataagtatttttcgttttgtggatt

SEQ ID NO: 71 - DNA, 91060 bp, Homo sapiens
agtgttttgaaatgtgtaaagttttttagaaatagaagtttttatttaagtatttttttgaagttttggtaagataattatttttattattttgtttgtgtttagaatgggtttataagtgttataattagaattattagatatagaaattaagagaaatgtagtttttttttttttgttggtgaatagagttttggttaatagaaaattaaggtgattttaattgttggtttttttatttgaagggggaagttattagtagaagttttaatttagaaattttaagaagaaatgggagggtgtggtgagggtaagtgggggattgtattttttgttttttttttagatggtgttggaaaatattgtaggaaaattatggatatttatgaagaaattttaaaatttattttttttgatgttaagggtttagtttaaaaggtgatgagtaggagtggttaatttttttttttaagagttggggtttgtaggagtttagttaaatgtttgtagggtgaagatagaatttagagggtgatattagtttgagtgggggttagaagaaatagagtggaggagtttggttttatttatagttttgggttagttttgtagtgaggagggggagaggaggggtttgggagggaggaggaggaggaggaggagttggaggaagttttgattggtatttttggttttagtttagtttggagtttagttttttattaaaggttgtttagtttttttgggttttagttttttgtaaggattgtaagagtttttttttgtagttttgagtttttatttttttggtggagaaaggttgtaaaaagaaaaagagatgtagtgagtgggaaaagtatgtattttatttaaatttaattgaattgaggagtttagggatatatgtttttaggtttgtttaggggtaagtgtgattttttttttgtttttttaggtttggggttagaaggaaatgtttttaatttgaagtgattttttttaggtagtgttagtggtttttatgtttatgttgattgttagttttttgtatatgttttaggtttttggaagattttgttgattttttttttttattttatggtaatgggatttttttaaattggttaaggttatgattgtttaagagtgtgagtatttttttattgtgtgtttgtggttgttatatgtgttttgtgtattttgggtggtagtgtgttttggtttatgatttatttaagttattgttgttttttaaaatttatttgggatttgttttgtttgtagaagtgtttttgttgaggattagtatagttttttgttgggtggttttgttgggagatgttttttgagttttttgggtggtgatattaggttagggtgtaataatttgtatgggttttttgtttagggttgtttatgggaaggttttggtggagtatatttgttgtttttataagattggagtaattttggtgtttaggattagggttaagtaaagggttgtttagttattgttgttaagtttttgtttttttaggaatttgaagtttttattggagattttgttttttggggttgtttaaaggagttgtaggggttagaggagaagaaggaattgggtatttgggtagtatgttgagtgtttaaggtagggtttttggggttgtagggttagtttatgttgtatagaggtgaggttagtgttgagttgggaggttttgagggttgttttttggtttggaggatgtagggtggggtttgggtttttttttgttgaggatggatatgtttgttgatagtggttagtttgtttggggaatttgttttaaggggtttattatgttggataatgaatgggtattgaagtatgggtggggttattgggagggattagggagtggttaaagaaaaatttgtttttataggaagttttaggagttagttttgaggttggtgtagattttaggagtaaatttttttgagtataggggagtttgttgtgttggatggggaggtagggttgtggttttggttgattggtttttttttttatatatagtttattttggtgaggattatagggtgttagagttgtagggtgtttagagtttatggggatggtggatgtttaatttgggattttttagttttttagggttttatttttaatgttgtaaaaaataattgaaatggttttaaaattaaagttatattgtttttaagtaaaattatattgaaaattgagtgggtggttgttgatgatattattgggatttttgaggtttttgttgggttaaagataatggaagagatttttggttagaagttattgatgtagtagttttttggtttttaaaatgagtaattaggggttttgagatgtggaattttttgtttaggttagggagtgagtgtttgagatggtagtgaaatttttttttattgaaggagagtagataagttagtgatggaggattttaaataatttatattttgttgggaaaattgttttgggtttattaagattttattaatgaattgagaaagaagggaggtggattgtggggtgggggtattggttttgtgattggaatattggggttggttgttttgtttaggttattttttgggggtggagggtgttgaaggaggggatttgtatgtttttttttttgaagtgggtttgtagttgaggatgaaagtttgggtggggaggtgtggtttttataaagattaggatgtaggaatagttgtttgtttggatttttttgtttagggggttttttgttatttagaggtttagtttttttttttttttatttatggttgagagaagttaggaagtagatattgagtggagtagagggtttgggaaggaattttatgttggggtgaagtgaggttgttttggttttttttatttaggtattggagggtgtggttatagtatttttttgggaggtggttggggaagtttttagaatgttagtttttggttttgttttttttttgtttggtagggagtgtgttttattttattatagttgtggtttataggtgaggggatatgtggtaaatgtttaaatttggggtttgaatgatatttttgatatgaggtaggtatttttttgaaaaattgtttttattttatattttattttatttttaaagtatttaggatttagtaaattgtattgattttattattagtgttttttgtgattttttattttagaatttaatatgtttttgatgagaaagtaggaagaagtttttttttttagttgattgttgatttatggttttaatgaggttgtttattttgattttagttttaggaatggaatttatagatttggatgtttaaagttagtttgaaataagattgttttttttggaagttttggaagttggtagtgattttttgttagtgaggttttatttgtttttttgtttagagtgtttagataattggattaagtgtagtttttattagtggttgatattattttttatttatatgtgaaattttatgtttaggatttaaaatttattggtaagttgtgaatattattgtgtgatatttttttgtaggtgtagtaatagttttagtaaaaatttttatttgaaagtttagttttgttattgttttttttggaagaagttgaaaatttgttattttttgggggaaggattgtaggtggtttttatttgatagggatgttgtgtattaggtagtttttttattttgatttatgggagtaaattttttatggtgttttggttgtagtaagtaggtagtaaaaaatatattattgttatataaatagttgatgatttgaggagggatttgatatttaaagaaaattttattagttttagttaagaaaatgaaagttgtaaattttttaaattttaaagtgggggagttttaaagttttttattaatttagatagttatgaattagataagaatggttatttttatttttttgtttttagatatagtttttttgtttttattgtaaaattttagtggaatttagtgtaaaaatttagtgtaaagaaaggataattttattttttaaataaaatatgttgtttgttttttttaatgtgtggttatgaatgttttatttttagggagtattttataggttttgattttgtagagatattttttttaataatttattttgttaattttgaaaaatataatttttaatatattttggttttatagtttattttgggaaagagatgaaattttgagggttgggtattgtggtttatttttgtaattttagtattttgggaggttgaggtgggtggattgtttgagtttaggagtttgagataagtttgggtaatatagggagattttgtttttataaaagtgttttaaaaaattaattaggtatggtggtatgtgtttgtaattttagttatgaggttgagttgggaggattatttgagtttgggaggttgaggttgtagtgagttgtgattatgttattgtattttagtgtttgggtgatagaattagattttgttttagaaaaaaaaaaaaaaaaaaagaaaagaaattttgagttagtatgtttattttggtttgtttttgaaaaggtagtttggtttttttttttttagagggaggtgtatttttgtgagttttagaaaaatttttgaagtggtgtttggagttttttagggtggagttttagggtttgtagtaatttagtgatgattattttagtagagtttgtgggtagttttaggattgatattttaatatatgattgttattattatatttattgtggttgtttataataatggaagtgtatatatgttagagttttgttttttttttttgtttaggtgtaagtgtattgagatgaaattgtgttattaaaggaggtatttttgtttttaaataattgtattataagggtatttagtaaataagatattttataggaagtattttatttatatttaattatagaggtttaaatgaatagttgggtgtttgagaattaaagtaggtttgtatatttatgttattgtgtatttttgtagaattattggattttagaattgtaagggtgtttgtgatatgttttttgatatttttttttaataatggataatgggttttaatatatttttaaaaatttatataagttatgattatgaatgttttgttttgaatatttattaatataaatatatattattgatttttagatttatgtttgtttgtttgagataattagtattaagattttgagggagataattttagtttagagtaaaataaataaataaataaataaataaaaaaaataaaaatttaattttttggttggtttttgtgtttttatgtttatttaagtttaataagatttattgtgtattatggttttgagttttgaggtttagggaggggatatatttttaatgttaaatgatgagttgatgggtttagtatattaatatggtatatgtatatatatgtaataaatttgtatgttgtgtatatgtattttaaaatttaaagtataataataataaaataataaaaaaagagaatatatttttggggaatattaaaaaaatgattaagatatagtttttttttttttggttggtaaatatataatttttgtttggttaattgaaatattaaaaaaattattattttggtggatggtttttttatgttttttatgttttagatgaagaaagagagtttagagaggtatgtttagtgatagggttatagagttagtagtagaattgtttgatgtttttaatatgtagatattttggaatttggatattttaagggggataagtttttaagagtgtattttagggtgttatgtggagaaaggtattttttttatttttagttttttttggagtagttttttttaagttgatttagtagaggagtaattgttgtttaaaaaaatttggaaagaaaaaggagagaagaaaaaaataaatatgaaaagttttgttaaatttttttttaaaggtaaattgttagttttgtaggggtttggttgtatttagtatagtatgattttattgtttttttgaagtttaaatttatgaattatagagaaatatttgagaattgtaagtggttagggaaaagtataatgggaaatgtttttgtaaaattttttgtgtgtgttatatattaggtttttaggaatttagagtattaggaattggttattggaaggaagagtttatggtttggtttaattttaaaattaaaaattgaatagtagttggagttgatttagattttaagggaaattattttaggaaattggttttttatttttggaatttttattagttgatttagtagtttagggttggtatttagagttagtgttaatttagttaaatttatagttggtttggtggtgtattagggtgttttgtttttaattggggttgtagaaaatttattatttattagagtttagggtaatagatggaagagagtagttgtaggattatggtttgtttgagtaataggtaaggagtttttttttatataaaagggaggttgggagagattggttgattattgttgatagaggtagtaaggaagtagaattttttaggttattgtaataaatttagtatggatgatattttattagatgttttaatttgatttttgaaaaggtttttgtttttaagaatgattttattttttttatttgattataaattagattagaaaatagataaaatatttaatttttttttttataaagagagtattttttagttattttaattatttatagtggaatattatagttttggaaaggttagtagtattttagtttattgttaagaaggaaaagataggaataagtgttaagttttaatttggatttagtagtgttatgtggtaaggagttggaatggagtgggtatttgtgtaatattttttgaagtattttttaatgtattttttttttttaatgttgaaatggaattagtttttgtttgatgtttataattagtagtataagtgtagataaaattttgtttggttgttgtatattttagaatgtggaatgtgttttatatttgtatggtggtgtttagttttttaaattatattagatatggaattttttgttttatggttattatttgtaatgttaggaatatgttttaaagtaatttttttaaatatttgggtaattaatttggagttttttaattgtttttgtaatgggaaggagatttatttttgaggagtttggtttaagtttggttgtaggttggtatatttttataggtgtttttatttatagagggagggtattggtaggggatgtttaggttttttttttttgtattgttttgttataatttataagttgtagaataggtgttgttttgttagattttattaggaagagttgaagattttgaatttgttattttatatttaataaggatttttgtaagtgataaaggattttagtaggtgataaaggaggtttagttattttgtttgatgagaagagttttaaaatgttgttattataggatatatatttagtttgagttaaatagattattgttttagagtatttttatagaatagaaatttaaaggttaggtgtagtggtttatgtttataattttagtatattgggaggttagggtaggaggattttttgagtttaagagtttgagattagtttgggtaatatagtgagatattgtttttattaaaatttaaaaaaaattagttaggtgtggtggtgtatatttgtagttttagttatttgggaggttgaggtgggaggattgtttgattttaggaagttgaagttgtagtaagttttgattatgttattgtattttaatttggataatagagttatattttgttttaaaaaaaaaaaaaaaaaaaagggaaaaaagaaagaaatgtgaaatttaagttgttaaataaatagtaaaaaaataaaatttgttatatttttttggaggttttttggagtttttttaaaatatttttttttgaggatttttttttgggttttttaaatattaagagtatattaaattttattttttttttattttaattgtaggatttaataaatttttttttagttttttttttgaggaaaagaatggggattttttttttaggatttgtgtaaaaagagagagaaagagtgagaaaaagagaaagaaatggggtgtttttttttgtagtttaggaatgggtgtggtaaaggtaagggtggatgagtgttttaaatttattgaaatttgattttttattttatagttagtgtgtatggtttttttattgtggtttttgattatttttattgtttttattttaaataggataattaggaattaatagaagttttagaatttgataggagggataggttgattttaaaaagtagtgtttggagaaaattaaataaatgattttaaaatggaagttttggatttatttgagtttttgtttttaaattatttttttgtgtgtatgtgtgtgtgttttttttttaaaaaagatttttagatatggaaaatgaaaaaggttttgagtaggttaaatgaaaattaatttatagaattgtaaaatagtttgggaaattatatttattggaatatgattgaatatgattttaggttgaagggttatgtagggtaatttttttgatgaaaggtatttttttaaattttaaagggatagaaattaaatggaaaaaggtattttaaattttttttagaatgaggtagagtaaataaaaagatgaataattttaaatagaaagatgagaatgaaaatgtgatgaatgttttttattgaatttgttttttttaggatatagaatttaggatgaaggaatagattttttttagtttaaggattttaagtagttaattttgagttttttttttatatttgaaagaatgatagtagatagttgatttttattgatatagaatttgtggtgtgttattattaaggaagtttattttttttttaaaaggtatggggagtttttttgagatttgggttaaatttggtatagtttttagggttttttggggttttttttatgagttttggaaatgttaatttgggttagggttttggttttatgttgtttttatttatgtagttttgaataattattttgttttgttggggttttaattttttagttataaaatggagggaaattagttattggatggttgggaggagggtgtgaaattttatttataagatagaagtttaggaaatgttattagtattttttttttttttttttttgggagggtggtgttggggaatgagtgtggatggttgttttatttttttttgttgaagagggtgggtggttatttggtgagatggtgtttgatattttttaataatttaaatgaaaaagttttttaaaatttgttgttagggaattttgtttttttataaatggagattttaggatatgataaataatagaagagagttaattgtaaatgaaaatattagtaaatatttaatagttgggttaggagtttatgagttataagatttgttttttgtatgatggtaggaaagtgtgtggggttaaaggtgttttttttatttgggaatttagtttagttaaattatatgggttttgaattattagtggagtttggataatgtattgttttataggtattattttttgttttttttagagttggaagggttttttttttttttttttttttttttttttttttttaatatttggatatattttggataaaataatttttgtgtatagtgtatttattttattattttgtgttttaatgggaagtatttttattgagggggttatttttttaaagatttatattttgaaaataaaaatttttatatatgatttttaatgaattaaaagtttattttatttagaatggttgaagtaagtgagtgatgttttagattttttggattttattttgtaattatttagattgtattgagtattttggaagatgagaaatgtaattttggaattgttttagagtgagtttatttaatgttttatatgtgatagaattagtggatttaaaggtttttattgtgtgaggtatgggaatgattaagaaaattattagtaaaatttgtttaaggtataatttatttgtgttttttgttaatgttttttgtataggtgtttgtagttttttttattttagatttaatagtgaggagatagtttttattttattatgttttattttttttatttggattataaagttgaatgttttataaagagtttttataatatttttgtgtttttatttataaataaaaatattatttaaaattatgttttttgaatatggattaaatatttaaagtaattgaattggattttttagaagatttgtattaaaatttttaattgaagtagtgatgtttaaatttttggggggtgaggagtggtataattgttttttagaattatatataaatatggatttttatttttagaaaaatttttatttatagatgtaattttgtatttaattgtgggaggattatagattttttgaatttgttgattttgtattaaaatattgatttggattagttataataatataggttgttttggaaagaataggttatttttttagaaagaatttagtaggaagtttatttttgttaaaaaaaaattgatgtttaagtttgatagaatgaattaagaatagtatatataaaatgtatttttatattattttgaagtgtatattattatttaattgaggttatataaaaaattagatattgtaattgttttttttttttatttgaagaaatatttaggaatgggtttaatagattgtagggaagaaaggtagagtttggtggaaaagtttggaaggtttttagggttgtatgggtttgagggatttttagagagtgaaggggtaaagttggggttgtggtatggtgggggtagggttaatttaagtggagggaggagaataggtagtttagtttgttgggggtttttgagttttgttgtgttgtgattgggttaaagtttgggagtattattaaattatagtataagtattggagattgtttttttatattgtgttaatatatatttatgtttaaaaggtagtgattattgtaagggaaaaaaaattgggttgagtttttgtaatattgttgttattattatttattgttgttattttgttgtagaaaaatatttgttttgttgataattggttttttgagtattattagaatagtattttttttttattgttgatgtatttttaagagattgttgtattgataggtggttttattttagttgttgagattatggttttaagtttttagaatttgaattatagggtatatttgttttattataggtggtattttttgttgattttttttggaaatttaaagttatatgggttttggtgtttatttttttgtttgtggttttatttgtttttattttattaatttttggtgggttaggtttagggtttatattgtgttttgttttttttatagttgggttgtaagatttggattttagtttttttttttgggtttgattttaggtaggaggaattttatggtaaatttatgggattgagttttaggttttttttgtatttatttagtttttgtttttgattggtagttttaattattttttgtggttttttttgtatttttgttaagtggtttatttggatattagtttgttgttttatttatggtaaagttatattatttattagttggatagatttttttttgttattaatttttaggtggtaaggttgagaatattagattatttttatttttgattttattagttgtatggggaaaatggaatttttgtgttatataatagataattatgaagatttgtagagtttatgggggtatttgtggagagaggaagattaagatagagatataaaagtttaggttttgggtggagttgattttaaagtttagaggatattagttaaggtagaagttatgtttgtattaggtttgaatgtttatattagatttttttttatttttatgagattttgattttttttgttaaattttaatattttgtatgatatatattttttttttatttttttttaaattttatttagaagtaagggtaaatattgtgttatttgaatatagtggtatgtagatatattttaggatgtttagttgtattgtttttttttagtagtttttaaattttattatattttaaaaaagagatgttgtatttatattatttttgttaaattgatggttatattttaggggtagttatttatgtttttaaaatttggtaaatgatattttttgtttttatttttattttaattgtggtaaaaattatataatataaaatatattattttgattatatttaagtgtatagtatagtagtgttaattatatgtattttgtgttataataaatatttataattttttgattttgtaaaatagaagttttatatttatgggatagtaattataattgttttttttttgatagtttatggttaatattattttaggttttttttttaagattttgattattttaaatatttttatataaatggaattataaagtaatgtatttgttttttagtgattggtttattttatttagtataatatttttaagatttatttatgttgtagtagataaaaggattttatttttttataaagttgaataatattttttgtatgtggtatgtataagatttagtataatatagtaggttgtgtatagtggtttatgtttgtaattttagtatttaggaaggttaaggtggaaggattttttgagtttaggagtttaagattagtttgggtaatatggtaaaattttgtttttattaaaaatataaagtttagttgggtggggtggtgtgtgtttgtagttttatttatttaggaggttgagaaggaaggattgtttgggtttgggaggttgaggttgtagtgagttgtgattgtgatattgtattttagtttgggtgatagagggagattttgttttaaaaaaaaaaaattatagtataagtggtgtaataatagtgtaaagttttaggagaattgtaggaatagtagttaatgaatttaataaatatttattatatatttataatgatatagataggtattttgttatattttgtgtttagagtgtggttgagttttatagttttggaagattttttgtttatgataaagtagttttggaaatttataattaattttataattgtaaaaaattttattgtgtgtgtatatatatatatatatatttaattaaggaagaaaaaaatttgtgtattaaaaattataaaatattgttgaaatgaattaatttttttatttattttatttattgatggatttttaagttgtttttattttttggatattataaataatgttgaaatgaatatgggtgtgtatatatatttttgagattttgtttttattttttttggatatatttaaaagtgggatagatgaattatatgataattttgtttttagttttttgaggaatatttatatgatggaggttagtttttttttattgtgtagttttgttgaagtttaaagattatatatatgaggttttatttttgggttttttattttgttttattggtttatatgtttgtttttaagttagtattatattgattttattatattattttgtaatatgttttgaaattataagtgtgaggttttaagttttgttattttttatttttttattttgttaatgtggtgtattatattgattggtttttatatgttgaaatatttttgtattttagaaataagttttatttggttagagtgtataatttttttaatgtgttgttgatttggttagttagtattgtgttgagaatttttgtattagtgtttattagggatattggtttgtatttttttttttaatattggttttataaaaatgagtttgggggtgtttttttgtttttaatttttttgagaaaagtttgagaaggattagtgttaatttttttttaagtgtttggaagaattttttaggagagatatttggttttgggttttttgttttttttttatggaaggtttttgattattgatttaattttatattaattttaagtttgtttagaattttttttattgttttatgatttagttttggtggattgtatattttaagtaaatatttattttttttttaggttatttagttttttggtgtgttattttttttattttttatagattttatgtagttttgttagtttttttaaagttttgtataaataattttatgtgtttgatttgtttttatttttttttgttttttttagggaattgttaaattatttttgatgtaggggatataaaattaatttgtaagtatttggagttttagaattataagatgaaaaaagttatattttaaaatttgatatatatttgatatttagaaagatgtttttgatttttatttatattgatgttgaatgtttttatatgttgtaatttgtgaaatagatttttttttaatttttaaattttaatagtgaaatgatgatgaaaatttaatttttttagattatatgtattttagttttttaagttaaatggaatttttaatttaattgtagtttatattatattatttttaatattaaataattttttttgaaatttaatataagaaaaaatgataatattaattagtgttatgaaagtttatgttgataatgagattgagtttggttttttttttgggtttttttggggaaatgttagttgtttatttattttaatttttttatttggttatagggaggtagtgagttttattattaagggatatgggttttatttatagttaatggagtttgagagagtagatatttgtaaatttagtgatttgggtttagtggaggtttgggtaggtggagatgtttttggttgttgttttagaggagtaagagtttagtaaaattagatatggagaggaatagtttatgaaatgtgtttggggaattttgggttaaattaagtatagtaggtttttttattttattttttagaattgttatatattaaggtatattgtaattgttttagaaggaggtttggtatttagtattttttaaattgtgttgtttatggaatgtttgtttttttttttagaatattgaatggaatgggtgttttatgaaatgtgttttgggaaatgttgatgaatgaaatgttgttggagaatggtagttagagtttatttattatttattttgtgttaggtatttattaaataggttattatatgttttttatagagggttggaagagaggtatggttattattgttttgtgttatagaggaggaaatggaggttttgagtaagtatattatttgtttgaggtagggtatggtggatttaggatttagatttatttgattttaagtattttgtttttttttaatatttttggttttttttttgatttttaaaaagtttaaatttaggttggtgaatttgattgaaaagttgttatggaattgtggggtttttatggagaaataaaaatgttttttttatttttttattttatgaatttttagtgtggtaggtgttattgagtattaaggtgtttgaatagttgtgtattttggttatttattttttgtatttttatttttttttgtaagtatgaggattagtatttatttttaaggataatgtaaagataaataatatatattatgaaaaattatgaaaaattgtaatgattatatagtagatgttgaataatttttgataatatggtatttaaaatagtggtttaataatattttagtttatttgtgttgttaatggttttgttttttagtattgttatttaaatttttgaaaagggaatttttgattagagagtttttaattggggaatttttggttagtttgggtaagaagagttattgatatgtatattattgtaaaatgaaaatgagttttttgtttaaatgttttaagaattttaagatagtaatattaaagtattaaattgagtatggggttttttagagtatagggttttgtgggtagttttgtttgtggtttaagaaaaagttaaaggaaattagaattttgtattaaggagaggagaaaaaagatgttgttttggtaaggggattttagtttagatagaaagattttagttttttggaggggttttaagggagattttagtttttaagttgattttttagattggagattggagagtgaagaggttgttataagattttgtggtaggaagaaaaggtgttggtaggggaaaggtttgatggtgtatgttattgagttgaagtgaatgtgaatttggttggtggggtattatgtgtgtggtttttagaggtgtgtgggtatgggagattttgtattagggtagttagtttttaggtttggttttatagttttattaattaaattattttaggtttattttattgtgagattggaggttggtatatggtagattttttttggaggaaaagtgttaaatattaatagagaatatggataaggtttgatatggttttagttgttgtggttgggttgtatttggtgtaatttgggtaaagtttgttttttttataaattgaaatttttttttgaggtttttttaaatatgatttataaatttaagttgggtgttaaaatttgatgttttgtgtttatgagtgtttttatttttgatttatttttattttgttttttgtttaggaatatgttatttttaaattgttgtgtatattatttagggaggaaaagaaggtttaattgtatagttttttagttgtggttaaagtaatagttattagatttaaaaatttttatttatatgtttaattaaaattattttttataatggataaattttttatttattagtaatttgaaaaagaaagagaatatttttagattgtggagaaattattatgaatgtttattttttaaaaatgtaattgtgttttttgaattatgtttaagaatgtttagagaggagagtgagtagtgttattataggtgatttatgttttgttaataagaagaggtttgaggtttttttagatagagagttttgtttatttattttttatttatttattttttattttttttttatttttttattttgtttttttttttttttttttttttttttttttttttttttttttttttttttttttttttttttttttttttttttttttttttttttttttttttttttttttttttttttttttgttttttttttgtttttttttttttttttttttttttttttttattttttttttttttttttttttttttttttttgttttttttttttttttttttttttttttttttattttttttttttttttttttttttatttttttttttttttttttttttttttttattttttttttttttttttttttttattttttttttttttttttttttttatttttttttttttttttttttttttttttttttttttttttttttttttttttttttttttttttttttttttttttttttttttatatatgtatatatgtgtgtatgtatgtatttgtatagatttttatttatttatttatttatttatttatttatttatttattatttatttaattgtttattatttatttttttgttgttggtttaaagaatgaattagatataaagtttttttggaagtttaaaaaggatgtagaaagtatgggattttgagagattttgtataatgagagttaaaaattgattattttttttgttttgtttttttttttaggtttatatttggtgtttagataaatttaaaatgaggaaatattggtatttgtttttagtggttgttttttgttttttttttttaggtttttttataatttatgtttagtagtagtaagtaggtaagagttagaaatgtttttgattttgtaaaaaggaatattattttttgattttagattttagatattaggtattgatatagagtttagatatgtttttaaggtagttaagttatttattataggatagttagataggatagttttaggatttataggtttttttagatattttttatttagtgagagatgatttatttttattaaaatttgggtttggtattttggaattggtttgaaaatgatttgtttttatattggatgtgaatggaaagtttgtattttaaatgttttattatttgaagggattttttatatttttggtattggttggtttttgagtatataaagtagggagaagttaatgattgagagtaaaaattattttttttgaaaaatataaagattattttttttttttaattttagatgtaggaaggtattttttatttaggatttttgaatttttaagatttttgttttttaaaatgaattaaaagtatgggttttaattaattttattaagaatttgattttagagttttagaaaagtgggaaatgttttatgtattgtaagttggaaaggatttaggtgggtttttttttttttgatttagagagtttggtttttgagggattttttttttaggttaggttgtttttagatggagggaagtttagtgttattttaatggaagaagaatgtgggttggggtattaggttagtttgaggtaagtagagtttagtagtaagtttggtttatagttgtagaagggtattttttggggttattgatagtttgatattttgagtttttatttttgagggagaattgggtttatttggaaatgagatagataatgtttgatatttatggagatttttttggttttgaaaaatatgtagtaattaatagagtatagtttgtttatgtttaaaaaatttggaaaaaataagtttttttttttttttatatttatataagttttttttgtttaaagaatatgtatttattatatttattttttatgtaaattatttaaagtattgggggttagtgaatggaaaatagtaatttttatttttttttttttgttaaggtttggttttgtattttaaattaaagaatgaatttataaaatgatggttggttgtttgtgataagatttttttttggtttaattaggtgggttttggggtttaaattgttatagggaattatatttgagttaaagatagtttaggaaattgtttttttaatttggagtatgttattggtttatttatgatggtttttgagtatggaatttgggttagtgattgggtattagtagttattgagtgtatgggtttaggtttttggtttttaggtaagtgagtttatttttttgtattattagtgaggtgtgaagtgtttagtagtagtatagtgtaaattaaatttgtttaggaaggttttgtattgataggaagtaattgtttatatagtagaaaaatttaaattaatgtttttttttaaagatgttaaaaatggtgtggttgttgatataatatttttagtggattttttttggattattggagaggaatatttttaatttgtttgagagtttttatatgatgttgtaaaatttttagttgtgggagaaaatgatttttattttgttttggtttagtttaatggaaatttatatattgagtttttgttaaatatgtattgtattaaataagaagtttttttttatatttttaatatgttttatattgggggaattaattagattggaaaaggattagaatatataatgtaaagttattttattaaggttgttggaagttgggttggtgatggagttttttaggttattgtagtgttaattgatggatatttgaaggatggttttgttttgtttttagtggaatttaagtttgttgatgttaatgtgtttgtaattggagttgaggatgtagatgaaggagtgttaaaagaaatagtaagtgaattgtttaatatgtatatgtttaatttagagaattttattttattttatgatatagtaggaaatttagtgttttgtgtgtatttatttgtgagtttagaaagggttggggatatggaaatttttaaagatattataggtaatggtaatgttattaagttatgttttgttttgttgtttttgggagatgagtttggtaattgttggttttaaagtaatagttaggatggtgggtgggttagggaagagatgagtgtttataggtttaaaaataaaggtttgatttggaatatttttttatagttttttttttaagtagggtatttatttatatataagaagagtttttttttaaataattaatatttttagtttaaaaaaatttatattttaatattatgattttataaaatatttttgttttttttagaaaagaaagttttagagtggtgaggtgtgtatttgattaaatttttttatttggtgttgggatttgttttttttaaggaaagttttttgttggagagtgtgtgaattgagatgggagtgagggtatttgtttttgtgtttagtggattagtagagagttttttttttttattttatggagttaatttaagagtgttggtagaattggaattataagaaattttagttatgatttagtttagattgattttggaaaaaatttagttttgaatggttagtgatagttggagttggaggttgtgtatttgggttgtgggtttggtttttttattttttttttatgtggtaattatggttgtgtttatagagatttttttaattttaatggagttgatgagaattattttggaagtattgagagtatatggatattgtattgatgtgttatgtgtagttgtatgtatagagttaattggttgataggttatttaattagttaagtttgttagttttttttttagggttaagtgtttaaatggttaatggggaaggaatttgataagtataattttaaattttattatattatagtaattgtaatgagtgtttagagtttatttattagtgatgggtagagtagagggatttttttttgttagaaaatgagtttatgtagttatttgatagttggtagtagagaattttgggtggaatgagtaggaaatgagagaggaatttagggggagagttgagttttagaaaggagatatatatgttttttgagatggagggaaggtatgagaaaaggggttgtgtttttaagatatttaggtggataagaggtatattgagagagtttaagttgagttgatatttattattttaataaaggagggaagtagtggggtttgggggtttggagggattgaagttatttttgattagttgttatagggatgtgaagaggggttataaaatatttaggaagtaattgttgatttgaagtggtatttagttgttattagagattataagttagtgggtgtttttattagtgtggatttttgtttttttgtagatattttaggtatttttaggattaaaggagtttttagaattggaatttgtaaagagggaataatagagaggatagaagaaaatttttttagtaaggaaatttagagtggtagttagtaaatttttgaaatagtttgttatggtgttttagttgtatggggagttaatgagagttggaatgggttaggagatttttgaagagttagaggatgagaggttaggttttggaaggagagttttggagatagttgagtgtgtaagttggagatgttgttggtgtgtagatagggagatttttgagggttaattgtggggttggaggagtttttaatggtgtttagtgtggtttttagatgtgtaggaattatagagagttagttattgtagaaattagagagggtggtgtttataaaggttgtttatatagattttaaagtttggagatgattatagagtttgtagtgtgaatgtaggttgaatataatgtaattaaattatgtaggaatgttggagatttttttttgtgtatttagtaggtatgaggaagtggataattttttgaattaaaaaagaatgagtgggtaattatatggtataggggaattgattataggaagtaagatttatgaatagattttttttttatatttttaaaaatggttattattaagatggttattgggataggaggtaggaggtgaggtgattgatggagagttagttttttgtgaatatatatggatggtggggtaggaaaaagagagttgaggtttggaggtatatattattttataggattatattggagggatagtagaagaattgtaagattgtaattagaatgttggagtagttgtagagaagtagtattagatgttagttttttataataaggatttagaaagtaggagttgaagagagatgatttaatattagtagaaaggaattagttgttttgagtaggtagaatttgatgaagaagagggttttagaattagttagttttagggtgttttagaagtttgtttataaaatggtttttttagtggttatttttgattttagttttaatggggttggtagtgttgatgtttttatttgtgggtttgtttttttataggaaagagtgagaggtagtttaaatattgtaaagtgttttttgtttttaaatgataggttttatttttggtattattatataggtattagttttgttaaatgataggaaaagttgggtgtttttaagagtattttaaattaaatatttaggttattaggaaatgataagagggtatttataatgaattgtattttttgttatgatagttttagtattattaattttttgatttattatattttggaatattgggataataataaagatttattaaaaaatagtgaaaggggtttatgtttataattttagtattttgggaggttgagatgggaggattatttgaggttaggagtttgagattagtttggttaatatggtgaaattttgtttttattaaaaatataaaaattagttaggtgtggtggtgggtgtttgtaattttgggaggttgaggtaggagaattgtttgaatttaggaggtggaggttgtagtgagttaaatttgtgatattgtattttagtttgggtgataagagtgaaattttgtttaaaataaataaataaataaataaataaataaataaataaataaatagtgaaagggattagtagagaaatggaatattttttattgatgttttgttatatttataaaaatagttgagtttgtttttatgtttaattattatgtaatggataaataatgagattattatagtgaatgttaaatgaaattattaatattgtgtgtttttatatagatgataaaatttttgtttttatgttaagaaagtatttttgttttttagtgtttaagttattagtagtattagggtagaaaattaatttatttatgtgttttttttaattaatattattttgtagttttttttagtattatgttttgttgtatgttttatggtaaaaatataggataataattttaggaagaatagtatatttttgtttatagttttttggaaagttagttagaagagtattatagagattgttaattagttagggttgtttttttttattatttgtttgttgggtaatttttttatagagtgtttttgattataaaatatatatatgtgtaaaatatgaatgattattattgttgttaatgaattttatttaaataattaatttttaatggttgtgtttttaaaaatttttttgttattttttaaaaaaatgaatatatttgagatataaaatttttattttaaaataaaagttaaaggtgatagggaggattttggtattagtttttttttttttgtaaaggatgaagatttttaaaatttgtaaaatatatatataattttgtgttttatataggaaataagaatgggaatttgttttttttaatgaaaggaggtattatatgagttaagaaaggtattgtgtttatattagtgagtttgggaaaagagtttttagggatgttaaaggaaattgtgaattttttttggatattgtaaaatttttttgtagaaaatattatagaggatgtgatatataaagtatagaagtagaaaattagataattttaaagtttttaaattgtgtatagatttgattttttgtaatattaatattggttattggtttgttttgttgtatataagtatatatggtttttgtgtgtttttgaggttttagtttttttgaataataaagtatgtttttgtatgttttattattgtgtgtgtaagaggataatgttgttatttagtgatgataaattatttaatgtgtttttatgattggttattgtagatgtttagttttttataagagaatgtttaaggatttttttttagggtttatttattttatttgtatgattataaattttaatttaaaagtaagttataaatggagaagaaatagtgttattttgtgatttagggattatttttaaaagtttgattgtattgattatatttaattttttttttaaatgttttgatatgttgaggaagtggtaaatttttttgtgttttttgaggttattggtttaggtttgggaaatgttgaggaattttgtggaatttgtggagtttttgtattatgtaatgatgtaggttatttttatggttttttgtgtaatttatattttttggtattatatttttttgaagattttttaggaattttatattttggttgaatagtggtaaatgttttgggttttaattaagggtttagttttatataaaatttttgtgtggtaattattaaaaatataagattttaattattgtagtataataattattttatttattgtattttataagaaggattgtgatagtaatgttgttaggttaatatatttttttatgtaaagaattaatttgtaaatatattgttaggaatttttttgtatattaggaagggaagagggtagttttgaatttggtaatttttgttttagtttatataatgagaagagtttgggtaagaatgtaattttattagagtagaattttttaattttgtgagataagttttggatttttttttatagtgagaataaaaataattttgttggtataaggaaatattaattttaaatataaaatgtttattgttattgaaaagattagagattagagtgaatggttttatttataatattattattatttaaaaatgatattttgagtgtagttttttggaattttagaatataaatagataagtttaagtttatatataatttttttttgtttttaatatatatttaagttattaaaaatattgattagaataattgtgtttttttttgagtttaaattagttaaatttaaatatttgaattgatgttgtgaaatttttggttttgatttttagattttttgatttttattttttttttagggttgttatataattttgtttttagtattaggttgggaattttttgtttgttattatgggggagagaagaggttttggttagttgtttttttgttttttgtataattttaggttaattttaattagggtttatttgatgtttatggtttttttaggtaattagtttaggatgttataaaaataaggttggataattatgttatgattggttttatattattttgtttaatattgttttgtattaagtgattgaatatagaggtaatgataaaataaatgaataaaatattttgtttaattttagatttgtatttgagttttatgtaattaaatattatttgagaaaaaagaataataaaaattttattaaagtattttttatatgaaaattttaaatgtagtttgagttttgatttatgaagttgtatgtataaggttattttggtttttaaagaaaagagaagaaataatagtttttgaaggtatttagtaatatattgggttgaggaattattaaattgtgattttgttttgtagttgtggatttgtataaaaaattattttaattatttgaggaggtaggagaaatgattaaaaattagaaattatttttaaagttttggtaatttatttattgattttttttggtaggtttggtagtggataatttatgttattatttttttttttaaatttagtggaaatttttagaatatgtatttaagattgtttttttagaaaagtgaatatgatgtttggaaatttaattatgaggatggtataaatgaaaaattgttataaatgttttttttttatattatgatttttaagaggttgttttttatttatttagaatgtagaattgaaagagaattttatatttttttattaatatgtgttttgtttgtttatattttgtgttttttattggtttttaaagaaatatgttagaatattgaataatgtatgtggttatttgttttaatgtttttatattttttgtattttttttttttaaagtataagattttgttgatattattttttttattgatggattaaataatattggaagtgttaattttgtagttatttttgatttttttgtaaatttttttgagaaatttttaattggaatttagtagatttgagtgggggtggtttagtttagtgatgagtttagaattatgttttttttggatatttattttattaaggtttaggttttgggtgtagtgaaagtttttgggtttgttggtggggagttggttaatattggttttgtttttgattttgtggtggagaattattttatttgggtagggggtagttgtgtggaggaaggggttttttaggtgttggtttttataagtgttgggttttttagtgatgagatttgttatggggtggtagtattgaagtaggttagtgtgtttttatttggttttggagtttaggttgtttttagggtagagttttagtatatagttattgatgataatttggtgtttattgttttggaattttgtagttttggggatttttaggagaaattattgttgtatattgttggtgtggtttaaaggtatattgttttgaaattgttaattattgttatataaggtatgtattttttttttattatttgtgtgggagtggggtgttgtgtgtgttggtttatatagatgtaaggtgggtattagtatgatttgttatgggagaagttgtaagtatttatagtttagtttttttttgatgagttgggttttggatgttatgtttgtgatgttatgtgtgtggaaaaattaaagattaatgagtgagtgaaagtttttatgagagtatgagttgttgagaaagtgtgtttttaaggttaatttaataaatttgttgttttgagattattaaatattattgtattaattatttataatttagtttttttaaaaatgggtttgaggggtttattatagttttgagaaagttattttaggattatggtattgagttttaaaagttagtgttagaagtgtgtttatagatagagtatttttttaaaagtaaagatggagtgagggtgtttttttaaagttattttgtgttagggtgttgagagttatatttttgaaggtaagaaataatagtgtaattatttgatgaaatatttatgaagtttttttttttttgtgtttgtgaagtgtaggagtaatttttttgagtggtaatattaggatataagtttaaatggagggtttttggtaaaatagttaattggagtggtttaaaaaataaaaaaattaattaagttatataataaatatgtatttaataaatataggaggtatggtgggggtattaggatgtatagttttttttattttttgaattgttttttgagatattagttattttttagatttattaattttattatttaggttaggttaataggatgttatttggtaaattagggatatagtggtttttaatagtttttagaaatatttaatttatttttagtgttgtttatatattgggatgttttaatgagattagtttttgattataagattttattttttattttttttttagagtatgggtttaatgaaaattggtgaatggatattgaggtttttataagattttgattattatttgtaattaattatttaaatttttttgggtgaaataatatattgttataatttttatttgttaattttataaataaagtttgggtttataagataaatattgtaataagatattgttttatttattgtattaattataattgattaagggaggtttttttttgataaaggagtgaaaataatttaaaaataattattttggagaatatgttattgtatgaaattaagagtagaagattttaaagttttaattaaaaatattattatttatttatttaaggagttgatttttatttaatagtgttttgttaattattagttttagttgttgtatttatgtaaaggtaatatattatatttttttataagggttataaaatttatattgagttagattgaatttgttttaaatgattttaaattatagtttttgttgtaataaaaattataggtagaaagtttaggttatggtatttttatttaatttgtgtattggaattgtgattaggtgatgtagtaagaaaagtatatgtgagtgttgttttttggagaaggttgtgtttggtatttatttaagtttgaaaggttaattttgtgtggtttagtttttgttgtatatagttttttagtttttttttttatttgatgggattataaaattggtttaaattttttagatgagttaatagagagattagaattttgaaaataatgttttgaatgtaaatggatattgagaagtaatggaaatagtgtataggattatatgtttggtgtttggagttgtttatgtttattttattatggtgttgttttgtgattttggtaattaagaaaataattaagtgaaaatttatgatttgttgaggtttttttgagtttgtatattattggtgtgtattttaaagtatagaagtttagagatttttttatgttttgtagatattgatgatgtaatatggttgtagatgggaaagttggtttttggttttgggttttttgtggatttgttatgtgattttgggtaggttatgtaatttttttgggttttgattttttgaatttatgataaaggagttgtattagatgaagatatgtttgtattaggagaagttttaattttttaatgaaaatgggtagtatatgatttttgttttagattttttttagttaagtagagttttaattttttgattataaatattatgtttaatattaatgattaatttgtaaatatttaataaatatttttgattatttggtatgtgttagatattatgttaagtattagagatatggtgttgtttaatgagatagatgtggttgtttgtttgttataggataatggggaaagagataataataatataaattagtgattaggtaaaatattttgagtatgataagttgtattggggtatttaatagggttgtgataggaagattggggaagggaattttagattaggtggatggaaggttttgagaaggtgtggaattgaaggtagatgagtatgtggagagtagggggaagagtggtttaggtagaaggaagagtaggaggggtggttttgtaataagaaggtatttagtttttttttagaattgttagaaggtagtgtagttggagtatattggatagggagtttgaggtttagattttttggatgtatggaagttggagaagtagttgttgtagggggatgagaagttatagggagtggagtttgtgggttgggagttaatggtagaggaaggtaggttgtgggttagtggtgggggtaggggtttttttttgagggtttttatttttttagagatagatgaggaggttttggaggtagtggtagagggttgagtagagagtatagttatgagatagttattttggaggataggatagttaattttttaaggaggtatgggaggatggtgggtaggtataggttttttgatgggggtttggagttttgagtgtggtatgtaggtattttgttgtgtggttttttttaggaatgtttattgtttgggtgatgtatgaggaagattgtgggtttgatggaggtttttaggagagtttgatggaggtgtagggatgaggtatggaggaaaatagagagaggtgtgggaggagggttgaagagggttgtgttatgttggtgaggagtagtaggatttttaagtttattttttaataaggtagtgaagttaggttttgtagagttatattaaagagataagatagttgtgtttgggttgatatttatgttaagtggaaggaaatgtgtatgtatttttgatgtggtttatagaagagttagttgtgagaattttaaggtttttattattgggttagaggagatttatggtgtagtttttagagaaatgaaatgattttgtaaagtttaggtgaattgtgttagagttatgaagtaaatataggaatttagttatttttttagttatttaatattttttagtgtttattatatttggttaagtatggttttaggtatattatttgttatgagtttttatgatttgaataaaaattaaatgtaaatgattttttatttaattaaaggggattttgggatagagtttttgggaattagaggtgtattttagggtttttagagttgaatttttgttgggtgtaaggagattaggttatttgttttattagatttagaaggtatttttttttgttggtttattgggagaatttttagtgatgtagtggtagggggagggaaaatgtgggagggtaggggatgatatttatttttttttattttaagagttgtgttattgttggtatttataaagaagaatataataatttgggttatttggtataggagtaagtagttttttaggttattgttatatgagtatttgtttatttttttgttatgtgtgatatatatagtaaatatatgagtggtagatttatggtatagtatatatggaatttatatgtgtttatatatgtgtatgtgtgtatttatatatatatatattttttttaatggtataaaggtataagttttttagagatttatatattagttttatttgtaaagatattttaaattaaaatgaaggggtagtttagagagatagtatgttttaaattaaatgaaggaaggaaagtttagaatggatgtttataataatgattatgaaatattgagaaaaggtttaatgatgttttgtatatattgttatattagtaggtaattgtgttattgtattaaggatgttggtgtataatatgttattttttttttagaatatagattttgttttgatgttataggtgagtatttagatgaggtattgttgtttttatttggtatgtattagtgatttttattttaggtattatgtttttagtttttggtttaaataattagaaatgaattgtattttaaaaatgtgttttaggttggatgtggtggtttatttttgtaattttagtattgtgggaggttgaggtaggtggattatttaaggttaggagtttgagattagtttgattagtatggtgaaattttatttttattaaataaaataaaataaaataaaaattagttgggtgtggttgtgtatatttgtaattttaattatttaggaggttgaggtgggagaattgtttgaatttaggaagtggaggttgtagtgagttgagattatgttattgtattttagtttgggtgatagagtgagattttgttttaaaataaaaataaaaataaaaatatgttttagaaggtagttttgatttttagaaagtttttttttatttttattttaaattttgttttttttgtttgtttttataaaattaatttgttatgtaatttatttgatggaatatagtaatagaggatttttttgtaaaatagtttattttaggtttaattatttatgtttttttattttttggaatttttgttaggtttttgggttaggtgttgtggttttaatagagtttatggtttttgtaatatgggtagggtgtttgtatatggatatagtagtttatagttattgtgagatagttattttattgagatgtttttgttttatggtttgtttttaagttattattgttatattatttaggatttttaaaaataggttttttgttttttttttggagatgaaattttattttattatttaggttggagtgtagtggtgtaattttggtttattggaattttttttttttaggtttaagtgatttttatgttttatttttttgagtagttgggattataggtgtttgtttttatgtttggttaatttttgtatttttagtagtgatggggtttttttttgttggttaggttggttttgagtttttgaatttagatgatttatttgttttagttttttaaagtgttgggattataggtgtgagttattgtgtttggttaaaatgtaggttttttaagtgaaaaatgtttgtggtatttgttggttttgatgttgattttttttttatatgttttatgttaagtaatttttttgtttgttaaatgaagatagggaatatagaattgaagagaatagggatgtgtaggtttttttagtttttgtatttgataatgagtattttgaaatgaagattgtgaggtaaagggttttttgagtagatattagtggtttttttaattatttaagtaatgattttattttggttaagttgtgtatttatggtagaagagaatttattgaatttttagtgatagtatataaaataggtggttattaaaattaaatttgtttttgtgtaattattttgtaaaaagtattgattgggtagggtggaaggtgagttagtttttttttagtaggtggggaggtaattataatttatgtgtttattaggataaattttttttggggtggttttgtggttatgttggttatagtaaatgagggtgttttttaaatggagttagttttgttgaaagttattgttgattgtgtttggtaaggttattttaattgttttataatgttgttatttatagttattgaagttaataagagagatatagtttttttggtggatggtttatttgtattgggattggttaattttaatgttatttgagattttattgttaaagttatttagaggttggaaattggataggattttatttaggtggtagtggtttagtatgtagatattgtgaggtttgaattttattttaatatttatttaataaaaagggaagttataattgttgtgtggaaaatgaagtttttggatggtttggttttgtatatgggttttgttttagattttgtttgtaataatttatttatgagtttagttggttattgggttgttgaggggatttttaagtttttggtgttgattataggtggtaagtttttagatgaaattagttagtttgtttaggagttgaagagaagtagtataatggtttttgttattgggaataagggtgttgattaggttgagttggaagagattgtttttgatttttttttggtgtttattttagttgagttttgagttgttttattgtaaggtatgttgtttggtttgttggtattttttaggattttttttggaatttttgaaggtatggtggtgatggttttagatatataatggggtggtttttaggtagggtttttaagaataaaataaaatgaagtgtgtttgtgtttagttaagagataataaatgatgaaaatagtagtaatgaatatgatttattttaggtttttttttgtattgggtttaggattgtatggtttataatgttatgtaatgaaattttatataagaattatatgatttaaattataggattatgggttattatttgtttttgaagtttttggttgaggaggttatattttagtttttattgtttgttagatttttgtgtttttttgtttttattggtgatttttgtttagttttttttttattattaggatgtagttttttttttttgagttgtttatttatttttaaatagttttagtttgagttgtttagggtatagtgtttttagtttttaatttttttttttttttttgttaagggattatttttaatgggaaagtatattgaatggttaagtgtggagtttaaatttagtggttttttaaattttttatttaatatgattgttagtggagagttatttttaaagatattatatagatttatgagttaatgagttgaagaaatataatttattgtttttaatgaagagaagatgagtattatagaatgatgtttttttattttgtagatttgattattagaggattgtttgatgtaggtatgatttatgttgtttggatgtatgttttttttttatattttttggttttttatatttattttttttttttttttttaaaattttttttaaaatttttaatttatatttttatagttaaagtttaatttaggatataattagttgtgaggtttaaattatagtagggtattagggaagaaataaaaaataaaattttaaaggtatatggtaaatgtgttgggttaaatatattattttgagaattatattttttatttttgatgtgtataagtttggttaagtttagtaattagtttttttttattttgttgtgtatttatggttttattattttattttgggggaatttttttgttggatgattgtttagtaagattgtgattttttaataggagaagagttttagtggagaatgataaatggggaagtttgaagaagattttaatatgagattagtttatttttgttattttttttagttttaaggaatttgtttttttaggttagtgagggttaattgtttttgagttatggatggaagattttttgtttgtgggtagaggtgagttttagaggatttagttaggtaaatttaaatttggttgggatgagtgatatggattgatgtagtatttttatagtatttatttttagggaaggagtgtttggttttaaggattttgattatttttgttgtttgtaaatattttaattttgatgttgtagttttttttgagttaatttggttttgtaaatttggttattaatatgttttataaatattagttattattagaggaaaatatgtagttatttgttatattttataagatggatatgttttgttatgttgattttttttgtgttttaaatgttggtatgtgtgtatgtgttgtaggtatatatgataaaattttttgtggttgtgtatgttttatttttttttttgtgttttattgtagtttatttaaataaaagggatattattttttttttggatggattagttaatgttggaaaaattaattttttttatgtgtgtgattttgtaatgaatttagttaatagttttgatattggaaatgataatatttgtgttggtttagtgtaatttagtgatatttttgtaatggagttttttttaaatatatattagattaagttagatatttttggttatttgaggtagttgtagttttagggaggtttgggtttgaatataggtttagttttaagttatgtttatgttaattattttatggaagttggtggtagtaggatttgtgaatatgtgttgtagtttttgtttttgtttatagttgggtagtttgaggatttttatttgtaagttgttaatgttttgatatgtgtgggtattttgattttttgtgtgggagttagttaggtgaataaggtagagtttgagtagattgtttttaatttaagtttggtgtattttatggatgattttagttttttgttagttttgttttagtagttgatttagtttttaattatatatgttagtggaggtgtggaggaagtattatttgtttagttaggtaaattttttttgttgttgggaattttttttttttttttagatattattttggagggtagtttgttagtttgaatttaagagtattgtggattgtataaagataattggtttttttttattgaaatagtttgaatggggatttgagatattgtattagtaaggttggattttgtttaaagggtgtttatgaaggaaagtttagaatatttagtttatgttttgtttattttgttttattttttatttagaaggatttttttttttttaatgattgtgaggattttggagtttgaatttagatttggggattatggggtggagggagatagagagagattttttttatatgaatatgttttgggattatttaaatgttgaaattgtatttttatatgatttttaaatgtttaatatttgttgtatttagaaaattatttgttataaaataaataaagggtgtatttttatgtaatggtaaaatggtttttaggggaaggttaatttattattattattgtaaattattatggtggtaagatatggttgtattagatttattagtttgttaatattatatagatgaatggtaagattaaattaattgaaatttaattaaaatagttttaagaattgttttaattgagaatgttatttatattatatattgtggtgttatagggtttgttatttgtgttttttattgttttattataatagattgggaagtattgataaggagtttgatttatatagtagtaatgggtattattgtgggttttggtttgtaattttaaatttaatgatttgattatttaattatagtagatttatggtaatttagttatttttgagtggttgatttatattagttttttttttttttttttagagattgagattaatttttttaagtaaaggtatattaagggttatgtttttaatatttttatttgtaatagtttgaaattgttgtttgtttttttggagtgattgttatttgatgtaagaatataatttagtggggtttttttttggtttgttttattgaagaagtatgatgttagatgggataggttgttttagttattagttttgtaaatatgtattgatttgaaataggatatttttaagataagtggtatgaatttgggttttttttttttttgttggtatagtggttattagatgagttttattaatttttgttgttaaatggtgttgggttgaagttgttttggtttttgttatgtttttgttttttattgtattttaatttatttttattgtagagagtaagtgagatattttgtttttttttgatggtttagttaattttgtgggttagttttttgttgtttgtgattttttttataagattattgatgagtttaatgtgaagttagaggggatttgaattgtggtggtttagtatagtgatgatgttaaggtggagttttgttttgatgagtattagagtaagtttgagattttgaattttgtgaagagaatgaagattaagatgggtaaagtttttaatttgggttatgtgttggattatgtatagaggtatatttttgtgaagtttgttggtagttggattgaggatggagtgttttagtttttggtgttgttggttgtaggaaggttatttgattgtgtggatgggttagtaagtaatttgaagtagagtggggttgtgttttttattttttaagttaagaatgtagattttgttgagttagagtagattgtgttgtttttagtgtttattttggttgtagagttgttttttaagattggagatttttatttatagatagtgaattttttaaaattagtgtataatggagtattagtattaggtatggtagagaaatgttagttgttttgttatttagttttttaatgtatgagttgagggtaggttgttggttattggtttttagatagaagttttttttgagtttataggaaaggtggaaaattaattatttgttggttttagtaggaataatagaatatgagatgtttttttttattttgattttttagttgtttttttaggagaatgagggtgagtatttttaagggtattagattattttatagtaagatatgttataaagatttagatattagtggttaaaatttttttttaaaaatagtttttatggtatgtataataaaagttatattatatggttatattgtatttaaaatagtttttatttttatatttatttaatgtttttatattgttataatttttttattatatttattaaaaattaaaggagtagaagaggtagataattttttattataaattttgtattaaaattttttaattgttaattgatattgttatgattttttatttaatttttttaatttagtgataaaaatgtagtgaagagagtaattttttttgtatgttttttgatgaaaaatgaagattttagagttttttttttgattattgggtttattggttgttggtttgggatggtaattttgatatttgggttttgtttttttttattaatttatttgtgatttgtagtaatttaattgaaattttttattgataaaatgttagtggttgtgtaggtgttgttattttatgtttttttttttattttaagtttttttttgaatatatttttgaaagttaataatattttttaagtattgaaaagttttaaaataaaaggggtttttatattggtgtattagttttttattgttgttataataaagtaatataaatttagtggttaaaaataaaataggttgggtgtggtggtttatatttgtaattttagtattttgggaggttaaggtgggtttattgtttgaggttaggagttggagattagtttgattaatatggtgaaattttgtttttattaaaaatataaaaattagttgggtgtggtggtgggtgtttgtaattttagttattttggaggttgaggtagaagaattatttgaatttgggaggtggaggttgtagtgagttgagattgtgttattgtattttagtttgggtgataagagtgaaattttgtttattttttgatttttttattgtaaaataaaaataaaaataaaaataaaaatttttattatttgatagttttgaaggttggaaattggaaattagtgttgttaagttaaaattaaggtgttaataggttgtgttttttttgtaggttttaagggattttttatttgtttattttttttagtttttaggggttgtttgtattttttgttttttggttttattttttatttttattgttagtagtttggtatttttttttttttttgatttttgtttttatttttatattttttttttaattttgatttttttatttttttttataaggatatttgtgattgattatattgggtttatttggttaattttagggtaatttttttatttttaaatttttatttgaattatatttgtaaagttttttttttaagtttggggatttggatttggatatttttgtgatgtttttatgtagtttattttgttgatatgaaattgttgttttgatgttttgtgtgagttattaggttgttttttttttagttttaggtgaaaaggatgtggtgtttttgtttgatggttttgagggtgttaggagtggtttttttttgttgaaagagtttgtttagagagtggtggaaagtttggatgtgggttaggattgggtttgtgtggttgtggtgtagtatagtgattggattaggtttgagttttatttgaatttatatatgaataagtaggatgttgttaatgttgtttgttagttgattttgttgggagggttgatttttaatattggggttgttttggagtttgttttgaggaatattttggttagttttgtgggaagtaggataatagaaggtgtgttttagttgttgattgtttttatggttgataggtttggggatgatgtgtggaatttttttgtggttgtgaagaggggtggggttgtgtttattggtattggtattgggaatgttgatattatagagatgtagattattttttttattttggattttgttgtggttatttttattttttgttagttggggattgtttaataggttatttttgagagggtgatttagtttatttgtgaggagttgagtaggttgtagttggtgttgtagtttttattgagtttaggtatgtagggaattttttgtatttttatttagtgttattgtttggggttatttgtttggattgtgggttataaggtgtttttaattttgttttttttgttatgtgaagtgaaaattaaaattataggaaaatttaggaatttatatgttttttttggttttgatgggtagaaatggtagaggtttaaggggggagatgttaagatttatgttttggggtaaattaaattttttaaaagggatatatgtgtagtttggaatttaggattttttaattttgtatgaaagtttttgtttagatatttaaagggaggggttgtttaattgataatgtttgttgtgtattagttttgtgatttttggtaggtttggttagtagttttttgtgaggtaggaaggagtttgattagggatattttgtaagttgggatatagattttgaaatattggtatttttagagttaaggtgtgaagataattttgattttgtttggtgttgagaagtgttttaattggtaggaaggttatttggtttttatgattatagtttattttatttttttttttttgttttttttttttaggtttggtataataaattaaaaaatggtgggagttttggtgttgagaaggaaggaggaaagatatatttattttttaataaatgttttttaagggttatttttttgggttatttgggtggggggggtttatagtggtgaaggaggtagatgtggttttgtttttttatatgtatttatttgtttgtttttttaagaggagagaaaagaaggaaagttggggaggagtggaggaaggagtaaaagtaagtgaaaggaaattattgtaggatatagtgggtgatgagggaggtgaggatgattatttgggtgtaattgagaggggtttggtttttttttgttggtgtttggggaagagagtagtgtggtttattaggtttttgtgggatgtttttgagtatttatgattaggtaaatttgggtaatagtgggataaataaagtgaaagaggttttttttttttttaattaaggtgttttgtgtgtttttaatataagaaaggaaatgtaatatttttaaaatgtatttgtttgtaggaggtttttgtgatgttgtgttttggttttagattgttgaggatggattttgggaatattgttatagtgtgggtgtagtttttgttgttaggaatgtatatttttataatgttgtggttttttgtttatttatttttttgtgttttagaatagttttttttttttttttttttttttatttggaggttttttttatattttttttgatttatttgatttttagttggtaattttgagttttatttttttaagaaaatgtaagtaaatttaaagagagttgtttttggttatgttattttgtggttttttgggtggtttgtttttgtttttttagttttttttttttttatttgtttagtggtattatttgtagtttttttttttgtttttgtgttattttttttttattgtgttggatggttttatttatgataaaatgtattgtttttttttttttaaatattttttttgatgtgttattttttttgttagtagtatttgttttttaaagatttatttatattttaaagtttttttttttttattttttttgagtttattttattttgttatttatttttgttttttttttaagtgttttagttgaggttattttatttgataaggtttttgtttttggtgaagtttagtggttgatttttgggtttttgagtagtatttgatgtagtgtaggttatgttttttttaagtattatttttgttggtgttgatgaggtttttttgattttgtttttgttgggttttttattttttgttttttttttttttgatgtgtaaatattgaaatgtttaggatttttattttttggatttttaatagtggtgattggtgttaggattttttgtttgtgaatttatgataaattgggtggtggtttatgaatgttaagaatttggtgatgatgaaggtgaagttatgtttatatttgttttgtaggtgttggtggtaagagggatgtggttttttttattgatgggttttaaagtgttgggtttgagttttagtatgtttgtatttttatagagaggttggttgattatttggatgtgggttttgatattatttgggtggttgttatttagtttagtgatgattttaaggtggagtttttgttgaatgtttattttagtaaggatgaagtgtagaatgtggtgtagtggttgaggtttaagggagggtggtagattaatgtgggtaatgttttggagtatgtgtttaggaatatttttaagaggtttttggggagttgtattgaagagggtgttttgtagtttttggtttttattttgtttggaaagtttgatgatgaggtggatgatttggtggtggagtttaagtagtttggtgtggttttttttatgattgttaggaatgtagattaggaggagttggtgaagattttgttgagttttgaatatgtgtttttggtgagtattttttgggagttgtttagtttggagtagaaattgttgatgtttattatgattttgattttagagtagatttagaagtttttagttagtatttgttatttatttttaggtgagatgggggtgttggaggttttttttggagtattttttatatgaaaaataataggtttaaaggttatggtatttataataaattaaattaaaataaaggttgtatgtttttatttttatggtttttattttgagatagggtttggttttgttgtttaggttggagtgtagtggtatgattataatttattttaatttttgttttttgggatttagttaattttttattttagtttttttagtagttaggattataggtttatattattatgtttggttaattttttgtattttttgtggagatggggttttattatgttggttaggttggttttaagtttttgagtttaagtgatttatttgttgtggttttttaaagtgttgggattataggtttgagatattgtgtttagtatttttatgttttttatgtttattagttagattttattaggatatatttgtgattgaataagttgggtttattgtttatggtatttagggagaatgtatattgtggtaaagtatgagggtatttttataggagggtggttggaaggattggggggatttgagttagtggtaggttattttgtggaaggtttaaagaaatggaattgtggtttggattggatgttgttaagatgtggaggtgattttgtagttgtattttaagttttatttagaagtaggatggttttggtatagattggtagagaagagtagttatttttattaattaggatagggagtgtttttgttttttttgtggtttgtattatgtttttttttttgtttgtgtttagatagggttataatgtggttttatttttattttgttttattgtgattatagagtagttttgtttgttgtgggggttttgtgagattatgtgtgtttaataggagaattttaaggttatgtgtgttggattagttttttaatgtgggggttgatttttttttttttaaatagttttattataagagttgtttagtttttattatgttgtatttatattgtaaattgtttaattgtgtatgaggtaaagggtaggttgaaatgtgtggagtagtaatatataagtttaataaaatagtatttgaggagtatttaaaattttaattaataggaaaatgtggtttattttttttaggattttttgattaattttattgttaaaaatgtattaggttgggtgtggtggtttatgtttgtaattttagtattttgggaggttgaggtgggttgattatgaggttaggagtttgagattagtttggttaatatggtgaaattttatttttatttaaaatataaaaattagttgggtgtggtggtatatatttgtagttttagttatttgggaggttgaggtagatgaattatttgaatttgggaggtagaggttgtagtgagttgagattgtgttattgtattttagtttgggtgatagagtaagattttatttaaaaaaaaaaaaaaaaattaaattagttatttaatagaattaaatatttttaaaaatgtgttaatgtaaagaaaatgagttagggtgggtgggggaagttgggtatggtggtttatgtttataattttagtattttgggaggttgaggtaggaggattatttgggtttaggagtttaagattagtttgggtaatatagtgagatttttatttaaaaaattaaaaaaaaaaattttaatgaaatttaaaaaataaaggtataggtatggtggtttatgtttgtagttttagttatttggaggataaggagggaggattgtttgagtttgggaggttaaggttgtagtgagttgtgattgtgtaattgtattttagtttgggagatagaaagagattatgttttagaaaaaaaaaaaagaaagaaaaggaaatagaggaataatagtgaaaaataaaaattttatataaatgttagagatgtgtgagtaaaaaggaaatatgagggtataaatgtttggggagtattaatgtgattttttggatatggtattgtgttatatgtattttgtttttatgggttgagattgtgtagtatgttgggatggtgttgggttttttaggggttttatttgttaagtgatggttttggataaggtgagaatttttggttttagttgtttttttttttgtataataaagatatagattttagtggttttggttttttttggtagtaatagtttatgattttgtagattatggtagtttaagattgatttttaaatgttttttatattttagaaattagtagtaatttagattataatgttaaaatttaaatagagtaaatttagaaagatatgttttggataattttaaatattttaaggagtagaaattgttttggtgtaaaaggtttaatttttaatggttaattttaaaaagtttgagatataaataatataggtattttgggatataattttaaggttgattaggattatggtgtaaggtgtatattaaatttgggtgagggttatttatatattgaatgttttttttttttttttttgatttgtagtagttgagagtgatgttgtagatattgtttttttgattgatagttttgagggagttaggttagatggttttgtatatatttgagattttgttagtaggattgtttgaagatttaatattggttttagtaaagtgagagttggggttgtgtagtttagtaatgatgtttttttagaattttatttgaaaatttatagattttaggttttggtgttggatgttatatggtgtttgaggtttagaggggggtttttattgaatattggtaaggtttttgaatttgtggtaagaaatttttttgttaagtttgtggggagttgtatagaagatggggtgttttaatatttggttttggttttgggtggaaaattttaggatgatgtgtttaggtttgtttaggtgatttgttttttgggtattgtgagtttaggggtaggagattggaatattgatagaatagagttgtagattattattaatgattttagattggtttttatagtgtgagagtttagagagttttttaatatagaagaaagaattatgaatttgtttggattttttgtagttatttttgtatttttaggggtggatatttttttttttttatggttaggtatgtattgtgtgatttatgattatagagtgtgatattaatattttttttttagttaaaaaagtaattagtagttatttttaataatttttttttttttgggttgtttttttagataatattagaaattaaatattggaaaagtagttttattgaaattgtagaaggaagtatattattgattttttattatttttgagattaattatagttttattgaaaggttttgtagtgttgtattgagataattataaatttattggtttttagaataggatggtatttttgaaattagttagtttatgttttattgaatgtgattttgaagttggtttatgtttattggttagatgtttaatatagtttaggtttttttattttttggtttggtgggattattagggagtatttttttggaagatttgtagttgtttattttagtttttattttgtgtttttggtttttgtttttggggttgtaaaagtaaagtggatttttttattagtttatatttttttttgttttttttttaagtaattgttatgtagatatttgaagtaaattattagggttggttttttaaaggggagtagtatgtttgtttttttagtttattgttttttattaggttgtttgtggtatattttatattttttatattgttttttatttttttttttttttattttagttttagttgtttaattataattaagaaattattttttatattattgatatttagttagtttttataaagtttttagattattatttaaaggttaaggggtttttttttattttttaatttgttttttttagtttttttttgttttgtattttatatatatttttttatttttaggaattatttaaaatttttgattataaaggaaatttttagtggtattttttaaaatatttgagattataaatgttaaagttaggtttttattgaatttttgttataatgttattttgtatgggataattgaagttttttgttattgagtttttatagagtgtgatattaaataatttttttttttttttttttgtttagaggatttattatttatttttttgtatttagtatgtttgggagttgtaaatttaggaattataggttaaagaggtatggatttgagtgaaggttttattgtgaataaattattaggaatgttttattttagttatttaattttattttttgtgtatttatgttttgggtttggaaatttaatttttttttatttttattttaattatttttagagaagaagaaagtagatattgtgtttttgttggatggttttattaattttaggagggatagtttttaggaagtgttttgttttgtgtttgaaatagtggatatagtttatgaagatggtgattttatttaagtggggtttgtttagtataattttgattttattgatgaattttttttgaaggatttttttattaagaggtagattattgatgttattaataaagtggtttataaagggggaagatatgttaatattaaggtgggttttgagtatttgtgggtaaattattttgtgtttgaggtaggtagttgtttggattagtgggttttttagattgtttttgtgattatgggaggaaagttggtggaagatgtataggatgtgagtttggtttttatttagaggggggttaaagtgtttgttgttggagtgaggaatattgatttggaggaggttggaaagatagtgtttaatagtgttatagtgttttgtgtgggtaatgtttaggagttgtttgaattgagtgagtaagttttggaaattttgtatgatgtgatgtatgaaattttttgttttggtgtaattgatgttgttaaaggtaatttttattatgtgtatattttttatttttttttgttgatatttgtgtttttttagttgtttggtttttggtgttgatttttggagtttttaggtatttggttgttttatatatttatttatatttattgggattggttttgatatttattttattattatttagggtgtttttttaagataagagtagaagtttattatattttgtttttataagatttattttttttttttattttttaattttttaaataatttagatttattgatttttgtgtttaattatagatttattagattaagtatttgagattagaatatttgatttttaagtgtttttaatttaaagtataaatttggggtgtatttaaatattagtggtgtattattatattaaagttaattaatattattaataaagttgattttttaaaatagtttattatttggtatttaatagttatttttatttttttttgtgagaggggtggatagaattgttttttaaagtttatatatataggattttattttgtatttgagtgtgatgttttggttttttgtttgggttgtttttattgttggtataagtagagtttgtttttttagttttagttgagaatttattatttgtattttttttttttagtttgtaatttggatgtgattttggggtttgatggttttagagattagaatgtttttgtggtttagaagggttttgagtttaaggtggatgttattttgaatagaattagttagatgtatagggttagttgtagtggtggttgtttgtttattgtgtgtgtgttagtggtggttaatatgtttttgggtttggtggaggtttttgattttgatgagtattagttagagatgtttgagaagttttggaatatgtgtagttagtatttttatgtttttatggaggatattttgaaggtttatttgaataagtttagatagtttttgttggatagtgtgaaggtttgtggggttagttggtttaggtgttttttgggaaatttttaaatttttattggaaaggaggaagttttttttttaagttaaattttttttatgttttattggattgttagtgtttatatggaaaattttttagttattaattgatttaatgttatgtattgttttttttattttggtagttttatgtaagttttaaaagaattttggaaattagtagtttaatttgaatgagttgaatttgtgattgatttatgtttaattatagtttagttaggtatgttttttatttttatttttttgtgtgtatgtgtgtatgtatgtatgtgtgtatatatatgtatatatattgtgtagatatatatattatgtgagtttgttagggattattatgaagtattatagtttggtgggtttttggaatagatatttatttttttatagttttggaggtttgatatttttgaggtgttggtagggttgttttttttgagttttttttgtttggtttgtaggtaggggttttttttttgtgtttttatatggttttttttttgtgtatgtttgtgtttaaatttttttttttaaaaggatattagttatattagattaaggtttattttaaagattttattaattttaattatttttttaaagattttatttttaaatatagttttatttttatggtattggggtttaggatttaatatataaattttgaggggatataatttagtttataatatatgtatatatgtatatatgtatatatatttatagatatgtatttatatatatgtatgtatatgtatttatatatatgtatatatatatgtatttatatatatgtatatttatatatttatatatgtatatatatgtgtatatatatgtatatataatgtatttatatatatatatatgtatttatatatatgtatatatatgtatgtatatatgtatgtatatatatgtatatgatttgtagaaattatattttagaaatatgagaatgagataaaaattgtttttattgttattgttgtttgttttttttaaaataaattaagtatttaaatatatttttttattttaagtgtaatattaaagttttgtgaatatgggtaattattttttaatttgggtttttagtttttttaagtgtaaaatgaagggtttgagatagtgagttttttagttttttattagtagtttgtaatatttttttttagtttttttgggatttgatagtttttttatttgtaggtggttatttattttattgatggagtagatggagatttggttgatttatatagagtatttgagaatttttgttaagaaggtaggtgttaaggttttttaaatatgagaagtaaattttggtgaggtggggtgtattgttttgttggagagaaatttttttgttaatgtagtgttttaagggagtagtgttgttttgggagatttttttttttagtgttgtggttttttattatttgtttggagttgtgggatggagttaataaaaattttttttgtatttagatagttttattgttgtgttgtggttgtttaggtggtagaatgtttagaaagtatgatgtttttgtaaaagattatgatgtattgatttatttaattttattatataaattaggaattagttattaataaaaatatattgttttatttttggtttgtagttattatagtttaatatttaataatattatatttaaataatataaagaaaataatgtaagtaatgatgtattaaatataaggtgatagttatgtttattattagatgtgatttttgattatttatttgttttggtgtttggtagtattgattattagaaagtggatgttattatagaagtgtaatttattttaagaattttttatttattagtttattttttttaagtaatggagatgaggttgttattatttgattttggaggtgttagtattttaatattttttatagtatatttgtgttatagagggtttgagtttgagaatttatgtatgaatatattttatggatgttattttttatatttttagtaataggtttagttattgatatattggaaataattatttagtagagtttaaagtttgagtattttaataatttagagtagttagtaaatttgattaaatatatttaagttaaaagttaaattttatattgaagttttttttaaaaatgtagttaggaaaaaaggatattgtattttttatatgtttaggtgagttgtattaaatgtgtttttttttgtaggagtttgtgttttgattttggtgggttttgaatgagtggttaatttggagtggttaatgtatttggagtttgggtgagggtttatgtatgataggtttttgaggtttaatttgttggatttggattatgaattagtggagtagtttgtgagttttttttatgtttttatatatagattagtgtagatattatattttttggtattttaagagaatgaagttaattattagtaggtgaatggaggtggggggggggttttggtagatagttaaatttatttaatttatttgggaattgttttgttgttataatatatgtgaatttggaaatggagatagtaaattgttggaaatttagtgagttggaaggggattttgggtgtgttgaggttgtggttttagtattttttttgtttttttagtaatggttttttttaatattattgtagggatgtaaattattgagattgtttattttttaattggaaattgtgttaagagtatttgaaattttgtatgataaaaataatatgtaggaaaagaaaggttgtttttgggtggagaagtgttttaattgttttttttagtttttttttgtgttaatgaagttttttttgaggtttttttattttttttagggttagttttttttagttggaggtgtgattttttgggtttagattggggatggagtttttggaagatgtggggttgagttgtgaatttagagattttttgatggtagtaatagtggattgtggttatgagaatgggaggaatggattttttttttttttatatttttttgtagggttagaattaggattttttttttagtggaagtaggttgagttagtttataaatttgggatatgggagaaagggaaagtttttggaagtttgttggaagaaagtgtatgtgtttattattagtttagtagatggaaatgtatttgggtatgtttttttttatataaggttaggggttagatgggatgagaatgtagagggtgtttgtgtgatttggagttgagaagtttttggttttgaggttaggattatttgtgtttgtttttattatggttgttttggaagtttttttttgggttggtattatattttatgatttttattttggttttaaggaagggtggttatggatatttgttttggaattatttttagttttggttatttgttatttgtttggttttgtattttggaattggaatatatgtaagttatagttaagatttgatgatggaaatttttagaaataaggtttagtttgtagtgatattgtggataagatttattttattttggttgttttttatttttttattggtgattttttatttgtattttgattgttaggagttgggtttttttgattttgttggtaatttttattatattgttagttgtttagtaaatgttatttggagggattttattttatattgtgaaatttttatatatttgattttgatttttaaagtgtatttatgattttttgttgggtattttttgagatttgaatatttggttttttttttttttggtaggataatattgttgagaaagtttgttgtggggttttttgtaagtgttttgggtagaggggagattgtgggtttattggtagtattgggttaaaggtatggtggttttatttttgtttatgtttgagatgaggtgttagaagtttgatattattttggtggggtaatttttttaatagaagagtgtggagatgaaggaggagatgagagattattttttatgttagaaggaggagttttgaggggtagatttgtgtgttgttttgttggggtttgttttagtgaagatggtttaggtgggattttttttttgtataggataaggggatttgtgttttaatagtttggttttttattttataaaataatgttaaaggtagttggtgtttttgatagtagtttggttgtgaatggtagttggaatttatagtatttgttttgagttagtaggaattaataggtttttttggtagagtaggagttttagagattttgatagagagaattgtgatatggtgtattgaggggaaaagtagtaatagggaaagttatgttgagttttagtgttgttttgttaaatgaagggggattatagggatttttattgtagagtaaagaagattatgggattaaatagaggatttgattattttgttttagggtatttttggagaagatggttattgaggttattttggtgatgagggtggatttgtaagtaaaaattgttttagtttttaaaattttattttttttttgatttttatttattgggattgtattgtggattttattatttgtttagttgttgatggttttttttttgggagaaaaattaatttatattttttttaataattttgtttggatgtttaagtatgataattgaagtatgataaatgtgggtatgaagggtgggatttgtttttattttgttttagaaggagggattaattggtttttgagttagagggatattgaatttgtatatttagtatttattagattaagatatgtaagtagagatgggagtgagttgaggggtagggatatagtaggagattttattagggttttaggggttattttgttaagggtagtttttggaggggatgttgttggattagattattagtatttgagggttttggggatggatagattttagtagtagggtttatgggagtaatgtttaagatagatatttgtttggggagttttgggattttagattaaggtttagttttgggataggggatagaggggtttatgaggaatagtgtggttattagggtttagttggtagggtttggttagagaattgggaattaagtattatttggaggagttgttagtttggtgggtttttttgggatttagtatttatagagatatagtgttgggggttatttatttttgttttatagggtagtgttgtttgtgttgttatttttttagattttattttttttagggaaattgtaggttttaggttaggttttatgtaggggtttaagaggttttttggtttatgtagttttgattggtgttttttatggtgaaatttgttttttgttgtatgttgtttatagtattttttatgttgttgtaagtttggtagagaaagggtgatgaagggttttagtttgtaaaatgtttttgttttttataatagggtgagtgtggtttgtttggtgtgaatggtatttaaggtttttagggttgtttgggttagagaggagtaaaggtgaggtgtgggtgatggggttgttagtgtggggaggggttaggtgatttgtagtttttttagatgttgttagggagggaggtgttggtttaggttttttgattttagtatttagtagtttgtgattttttattggaaggtagttttgagtagggtgggtttaggagtaggggttgtagttggtggggagtttgagaatggagaaatagttttttgtggaaatatgaagaagttaggaaatttttataaggagagaatatgggttagggtggagggtaggttggtgtttatggttttggttttggattgtgggagtagttagggaagggagtggagtgagaggatagtaggtgggttgaaggttggtgaatttgtttttttgtttgttgaagtttgaaggtaggtgttgaagggaagggttgtaaagttataaagttagttttttgttttgggttttggggtttatttttgttggtttagggagttaagattatttaagtatttagttttagttttagttttaaaatattgtatgtggtggtgagagaggaatttaaaggggtaggattttaatattatatttttagatattgtaatatttaaatggggtggagtgggggaatagtttttggttttttttgtttgagggattagttttgtaggaaaagttaatgttttttttattgttttgttttttagggtttttggggatttttaggagagaaggtatgtaagtttggttttgttttataaatggaaaatttttttagtattttttatttttttttttgttagaatagttttttatatttatttgtttgttttatttttttttagggtgaagtaggagaaattggattggatggtttggatggtgaagatgtaagtgattttattttaagtttaaattgtttttggttttgaagattttagaaattaataatttagtttgtgatagaaattgtagtaggtgtgatttttaatttttgtttttggtagggagataaaggattgtttggtttttttggagagaaagggaattttggaagaagggtaggtgtatttttatggtggtgttattatggaaagaatattaatattttatttagggaatagttattttttttttttatatatattaagtttgttttttttaggtagttttttttgattttttttgtgagtgtatttattatatttttttttagttttgatatattatagtatatttttttgttttgagattatattttatagggtagggattgagtttgttttgttataaataaatttttagtgtttggtataaagtgggtttttaataaatatttatggatttattaaatgaatgaaaaatatgtggaagtgaatttgtttttatggtgaatgagtaaattgtaaatattgttttagttaagatttatgagttgaagaatgtgatttttagggtgagataaaaatggaaatatttagtttttagtatttatttgtgttttttttttagggtgataaaggattttgaggagagaaaggagaaagaggagatgttgggatttgaggggatttggtaaagatttttttattgatgattttagatttgagtttggggaagagggttgttgggaaagggggatgaaaggaagaattttatttttgaaattgttttaaaatatgttgataaaatatgtgttttgttttttttttgtagtttgggggtttggggagatgtgttggtttttttgttaattagataattatttgtaagttttgttatataaatatttgagaagtttttaaaaatgtggtattagggtattttaaatttgtttttggaaaagagaagagtttgtagttttttttattttgtgtttttgtaaaatgtttaagtaaatgagtagtataagttagtttttttttttagtttattttgtttttgtggttaaggataagtaggagtgagtttggggtatttttttttttggggaagaatgattgtatttgtttggggttaagagtgttttgttgattttgtgattgggttttgtaagatttgtatggatgttatttggatgggttgtggttgaagggtttgttttttgaagttttgtatgtaggtttttgttaatatttttttgattatttagtttagtggtagttgttttttttttatatgtggtttattttttttttttatgttgtttttagggtaatttaggataagatagttaggagagaggatttaaaggagaaattggtgattttggttttatggtaaggtgttgtatatttttagattttttttgtattgagggtaagagaaaggatatattttttggtttattagtagttatagaggttaaagatgtggtttttaatattgtaatgtagtttaagattagtagtagagtttttgtgaaggaagtttttgtggggaattagagtgatttttgttaagtggggttttttagtagaatttgtgttttttagatatttatggaaggtgtttgttaagttaaaggtttgtagaggtgggagtgtattgaagtttggtgtattttgtaaagtgtgtaattgttttgtagatgggttttttttttgtgaattgatttttttttttgtaatgttttgtgtagtattttagagttagatatttttttttgtagatgagaattttatgttaattttttttatattagggtgttttagggagagatggagtatttggaggatttggagaaattgggaagaatgtgagtgttattagggttttggggggttttgtgataatttttagtgttataagatttgtttaatatgatttggtgtatggttagtttatagttttgtagtgagtgaatgtaaaaggatttttgaaatggttgttattttaatttatttttatttttataatttttttggtgttttattttttttttttttttaatttttgttttttttaaaaatatattgaatagatatttttaaaaataatatttttgttatttttaaatattgggttaggtttgatttaattaaatatttaagagatttaaatggaaattttaatattgggggagggagggaataaggggtaagagggttgagggagttgtggatttgttgtttttgtaattatttgtgggtttttggggggatgttgtaagtgaaataaaaaaattagattttttttttttttggtgtattgtattttgtaattttaagatattttagaaatgtttgtagtagaatagttttttgtatgtttaatttttagttttgttgaataaatgttaaagttaaagtgatgtgaatgatttttttgaagttaattaaaagtttttaaggtttttgggtatagatagtatttgttttgtagttgggagaagattagtggtgtagaagtttgtaattttttagaggaaatttaggatgttggtgggtgtttaggggaggtttttgtttagaaatgaatagagtataaaggttgtaagttggggttgggtgttgggaattgggtttttagttatgttttgaggggtagtggtttgtttggtttggtatttgggttagtagagtttgttggggtgaggggtttttaaaaggagtgatttattaaaattaaattgatggattatgggtattattttgttttgaaaatttagaagaaaatagaaattttgaaaatattattttaaaatgtttgagtattatttatttatttatttttaataaattgtaaagatttggattaattgtttggaagtgagtattatttttgaataatgttatataatgaaaaagaagttatataatgaaaaagaagaaatatttattaaatgttataatgggttattataatttagtgtgtgagtagagttaaaatttggttttatgaaatgatttaaaattgagtagtttatataattaattttaattttatatataaggtagaaattggatttgaatttggttttagttatgggtttttgaggatttagtttttttttttgtggtttaatggtttgttatttttttttttaggattatagtgttaggtttaggttaagttgaaatgtgttttttttattgggttttagtatgtttatattttttttttagagtttttgtaggtggtttttggtttgagtaatgtattattgagtgttgttggatttttatggaattttagtatgttttttttgggaggggttaggttagattgttggtttgtagaggagaatagtgtttttttgttttaaattttttatggaaggtggttaagattttttgttgaagtaggtggtattatagtgaataatggtaaattggttattgtagattattgggttggtttattggaagtggagagtgaggtttttaggttgatgtagtagatgattgagttttataatagagttagttggttatagtttttgtaatattaattttaattttgtaaagattgtttgggatatttataaagttttattttaaatttttttattgttgaggaaataattttgaggtggaaattaatggattatttgtgaagtaagtttatatgtttgaattaaaggttatttttggagtatttaggaagatgttgttaagttgtgagttttatttaagtatatgagatgtttaggtgtatatgtgtgtgttttagatattttatttaattgagtgtgtgttgtgtttggttgggattatttggagaatttgggatttttttttattataattaatgtattttatgattttttagtatagttgggaaggtggaagaaaaatagataggttgatattttttttttatattttttatttgaaattggttgggattgtgtagttaaaaggagttattattttgtttggtaggtttgtagtaatttttaaaatttttattgggtgattaataggagtagtaaggaagtaaaattttatttggatgagggtggaggaagggtgtttgtgtgtgtgagtttttttagggttgatgaggtgtggtttttggtttttggtatgatgtgggtgtttgggaagatttttttgagtaattgtagaataagagggtgaagtttgaaagagttttaggttttatgtttagtgttttatgtttttttttatagtttgtgggatttttttttttatagggtggttttggttgaaggggattttttggagttaaggtgagttttatgtagtgttttttggagattttttttaaatagtttagatgttgtttagtttaggagtgaaaaatatttttttttgtgaatttaaagttttggagatagatattaattaatttagaaagttgattttgttaaggttaaagatatgtttgtgatatagttttagaaggttttgatgatatttgtttaaggtgtttggggtatagtttggttttatatattttagggagatatgagatattaattaatatgtgtgagatgtatattggtttggtttagaaaggtgggataatttgaggtaggggaggaggtttttaggttataggtagataagagataaaaggttgtatttttttgagtttttgattagttttttattgaatatatagtttattagaatagttatttatgttttagttaggtttagtgaaaaatagggtgaaggaagtaattggatatgtttttgttttttatgagtagagggatgatttttagttttgtttgttttttgtttataaggaatttttttgtgggtagaatgtgagggaggtatttagtttaaaaaaaaaaaaatttggttaggatggtggttgatgtttgtaattttagtattttgggaggttgagataggtggattatttgaggttgggagtttgagattagtttgattaatatggagaaattttgtttttattaaaaatataaaatagttaggtgtggtggtgtatgtttgtaagtttgtaattttagttatttaggagtttgaggtaagagaattatttgaatttgggaggtagaggttgtagtgagttaagattatgttattgtattttagtttgggtaattagagtgaaattttattttaaaaaaaaaaaaaaaaattttttgtagttattttatttaagaatagaatgggaggtagttttgtttgatgtagtttttagtttgatttttttttttggtttagtgattttggggttttgagatttattttttttttattttttttgggttgttttggtttttgaggttttgttagttgtttttttaaatagttttttttgtagagtttagagaaaatggtgtttagtggggatttggggtttaagtgtaggaaatatgattgaggtagtagtgttttgggtgggtgttttttttagaatgtgtttatttatttggttattagtaatttgtaattttttggtgttttggttttttgttttaggtttaaatgatttttgttttataaagttgtttgaggagaggtgaggtaagagtgaggaataattgtagaagtgtagggagatagttggtttttgtgtttagtgttttatttggggttattgttttgattatttgttatttttggaagagttgagttttttttggttgttttttaagtttttggtttagaaatgattgtagagtaaagagttgatattgataggaattattttgatttttttttgtatttttttttattttaaagggtaataagggtggttttggttagttgggttttgagggagagtaggggattagaggtgtataggtgagtgtttttgtgtgtgattgtgtgttttttgatattttataaattatttaaaaaatgattgggtggtatttatatttggaaagttaattattttaaagtgaataatttagtggtatttggtatttttataatgttgtgtaattattatttttatttaggtttaaaatatagttttgaaggagatttgtatttattagtagttattttttattattttttattttgagtttttggaaattattaatttttttttttttatggatttgtttattatggatattttgtataaatggaattatttattaggtagttttgtgtgtgtggtttgatggagtattatgtttttgagttttatttatattgtagtatgtagaagtattttatttttttatatgatggaaggatattttgttgtgtggttatagtatattttgtttatttatttattggttgatggagatttaggttgttgttattttttggtaattgtgaatgatgtttttgtgaagatttttttatatgtttttgtttgaatgtttgttgtttgtatatattttaagtttatttgtttatttatgatttggattgaggtagttgttattgtagttaagataggataattgtgggttttggtggttgtttttggttagtagaagtgaggttttaggttttgtgggatgggtagatgttatgtagaggttttttatggaaagttattttattagtatttatgatggttttttttttttttagggtttagttggttttgttggttttttagggttgataggagaataaggtatttttggattttgggtaagtttgttttaatattagttttttttttagttgaatagagggtatattgttaagtaggttgagagagttttttggatgatgttattgtagatagatttttttttagtttttttttttggtaataaaaattttagatttaattttaggttttgtagtgattggttattttattttaagaaagtaagagtttttttttttggtgttttatgggtttttaagttttaattttgttttttttaagtgtttttgggtggaaattaggggatatgttttaggatggaattttggaaaatttaaatttattaaaatgtttagattttgtaaggtgttttttttttggtttttggagatagttttttgtgtttatgtattttgtatagtgagtgttttaagtttatttatgagtttagtatagaagatggtttttaaatttgttgtgattgtagatgttattttgtaaagtagttattagtaatgatgagtagagatatattgttattgttgggttaggattaggtgttatggaattatgtatttgggttttttttatggttgagatgatattgagggaggtattttattatttattattaaaaaatgattaataaattggtaatgagtttaatatgttgttatataaatgtataaaaatattttatggtggaagtaggtaagaatttgtttagaaagtttttttttagtttgaaagttgataaatatatatttttagatgtttttaaaaaatatttatttaatttgtaattaattaataatttaagatggtatagatgtaaagttatttaaatagttatttagtagttttagaaatatttattaatttgtatttttttattattttttttatgttatttgtgggttgtgtagattgtattatattttaagagttaattttatttattagtttatttatttatttaataggttttaatatgtttatatgtattaggtgtttattgtgagggtgtgaaaagggaggtagaataaagttatataaaatttgggagtttgttgttttgttaggaatttaggatatgtatattaataattgtaatatgtattaatttgtgaaaattggtattgagaggtaatatttatgttttaaatttgtgtatgttatttttgtgtatgtttatatttgagtttgtagttttgtgtttagagttgagtgtttgggatttgtaggtgggataggttttatgtttttggtgggttttgatttttatgtaggggagagttaggttttagagattaatttgtttggatggttggttattttattgatatatttttttttttttgttttagggaagtggaggtgttgttggtgtttttggagaatgaggtagaattggtttattgggaagaaaggtttgtttttagaaaggtagagtttttttgaggatagggattagttaggtatatatgtttttttttttttttggttagtttgtttgttttttttttttagtattattggtttttattttagttttttttgttgattgtggtttggttagtggaattattgttttttaataatttttattataatttttattattatttttgttattaattatttttgtttagagggttggtttttttttggttatagttttttattagttgttaggttttttgttttttttttgtttggtttgtgttaatagtgtagtattttttgagttattagagtagttgggtagtgtttggtatagttttagtataatatggaatgagtagtttttaaatatgggtagtgtatgtatagtggtttagttaattatatttagattatttaagagttttgattttgattgttttggataatagtaagtttgttgtatgaaggttgtttgagaattttttttttattagttttgagataaattataatttgttataattagtttgaaaagattgtatgttttttgtaaaagaaatgagtttttgtgaatttatgatggtttttgtttggagagtgttttggggttttatgttgggtttaatgtttattgttttttgtgttttttttttttagttgttattttttttttttattagtttgttttttatgttatgttggtgaaaaggataaataaaatttttttggatttttttttaggagtttgtatatgaatgttgtaatttagaaaattattttattgaaattttaaaggtgaagttagtatgttgtagtatttttatttagagtaaaagtatggtttggtattatattgtaagttagttttaggttatagggttttagttatgttttttatgtttagggtgagtttggagagttaggattaaaaggaggaattgggaattggggtttttgtggggagatggtaaggttatagtgtgtttggggttaggttgttgttgattttttgttggaaggtgtaggaagttaggagagggttttaaataaagatgagttttgttttttgtattattggggatatggttggaaatattgaaatttgtttatttgtggtaaattaatttaataagttttattttattggtaggggtagagaggtggggtgggttgtggggagagatatttttttttttgtgttttttttgatataagagaatgtagaggttaatgaagtttaaattatttttattttaggttttgtaaatgttttgtaagtataattagatgaagtttttttgtaaagaagtaaatgttatttgggttaaaatggaattggatttgattaggttttagtttagatggaaataattttttttgaatgagatattttaggaatagaaattattattttagtaatttgttttttaaatgttatttaaaaatgttttaaaaatttattaataataattttgtgatgtatatttttatgttataaaagaataaagaaatttatggtttattgtgattttttttaaaaggagttatggtatttaatattgtataaaaggattaggttgatttgattgttttaattttaagtattaaaatatttttttgttttttatttttgtttttttaattaattgaagtttaaaaatgaatttgtttgtattatttttaattttagaagtatagggaaaaaattagattttaaattattgaaggaaatttttttttgattttgtttttagtaatttgggttaatagatttttagttgttgatatttgttgaaaattgtaaattaattaagtggtaatttttatatatgttagagatagtaatgtataatttatatatgtttttttgatttttttgatttataattaatgatgtttagttttgaatgttttttatgagagagtaataggaatagatttgagtatgttggggggaggtgttggaaaggagggggtttaggggtgatgatttggaaggaagggaagggatatggggagggggaatatgatttgggtttgagagatggagtttagtgttttggttttgaagtagaattaaagatttatggatgtatagaattaaagtaattattaagatttttgttaattttaagatttttggggttgatgagtttttgattttatatttaaatagaatttttattaaaagtaattagtagttttttttatgttagtttgttagtgttattttgttatgggagttttttgagtttattgtttatagaaatggttttgtttatatttggaagataggataggagtaggaagtgtgtttatttttgtattttagtttgtaaatattttaggagtttaaggatttattttttaggggtagtggtagggtagagatggtggttatggtgtgttaggtatggtgatttatagttatattttttttttatttttagggagatgatgggagagatggagttggtagtgaaggatgtagaggtaaaaaagtatgtatttgttgaggattatttaagtgtttttgttgttaggaggttttaaggataatttttgatgtgttgtgttttaaaagaattatttttttaaaaattgtttttgtatttgagtgagtgtttttgtttgatgatttagtagatattttttttttttaaggttaatttattttagatgaatttaaattagaattaagtattaaataatttattttttttttatagggagaaagaggattttttggatatttaggattaaaggtaaataatttttggttggtgaagtattattatgattttgggatggttttggtatgtttatggattgagaattagaatattttggtattagttttgggttagttatttagttaattgggttattttgagaaagatttttttttttttaaaatatttttttatttgttaagtggaggttataatatgtatttgttttggtgtttatgagatttaaataaaatatgttgtaattaaagtattttgtaagttgtgaaatgttataatttatatgatagtattattattgattaattaaattaagattatttgtaaatattataaatatagtagtaatttattggaaaagtgaattaaaattaattatttggttgtttgggaaaagtgtgatttatatgttttttggatgttttattttatggatttttagtgagattttttgttttaaagtttattgtgttattttttggttttttttttagggtaatttaggtgaatttgggttaaatggaataataggatttaaaggtattagaggttgaagggtaagtttgtgtgggttttggttgtaggtgaggaatgagaatgtatgttttaatgtgattaattgttgaggttttgataattattttttatttgtattttggttagggatagtatagggtggaaggaagggaattttgagttttagattaatgtttttagggtgttattatggttgtggtttatggttttttttttgtaggtgtatttttttttttttaatttatttttagggttgttagtttagtttattttaggtatagtatttatttgtagttttgaattttattatgggtgattgggaagtttgtgtagttattttgggttatgtttatttagatggttaggtaatgggagtgaatgaggtatggtaattgtttttgaagtttttaggtttgtaagtgagttaggttaaggttatgggttttttagattattggtgttgagattttttttttttaagttatttttagttttgatagtttttttttttttattttttgtgtgtgtgtgtgtgtgataaggttttattttgttgttaaggttttagtttgttatttgggtggagtgtagtggtgttattttggtttattgtaatttttattttttgggattaagtgatttttttattttagttttttaaagtgttgggattatatgtatgagatattatatttggttagattattttttaatggatgtttatttatttttttaaaatggtagagtttttaattagtaaattgtggtttagatttgtgtaaaggttgttaatagttatttttagtttgaaatgtagtttaaaaagaaatataattattttattaatttgattagtgaagatagttaaattagattatttaatattttaaagagttttaaaatattggatgattatttatattgaatgtattagttaatttattgtttgttatttatttttttgggagtttttagtaattatattagtggtttttgggaaagtatttgttttattttagtttggtagagaatataatatataatatttttatagttggtgggggatttttattggttttgttgaggttgtttgtttttaaatttgaatttaagagatattttagtttttttaaagtgagagattttttgtggtgatggagttttttgggttagattatttttattgtattttttaattataggagttttaaattttttattttttgatatagttgaataatgtttgttttgttttttttagggaaatttgggatttttagggatagttggatagaagggagattttggttatttaggattagttgtaagtatttatttagttttgatttggttatttggggttgggtgttttatatgtggtttttgaaaattttttattatttgttttgtttataagaaaatgtgttttttttgtatttgtttggttgttaaattgtttttttgatattatgatgtagtaaagagattttgaattttagagtaataagaaattttaaaaaaataggttttatgggatattttgttatttagggagtattgtaatttgtttttatagttttttggtataggtgtatttgaggtttgtgtagaggagaaattaaagaggggaaatttaaatattttttgtttgtattttgtagaagtagtgtaattatgttaggttttggtttgataatgttttttgtggtttatgaaatttttaagggagtttttgatttgtggttaaattttattagttatgttgttattaggagttaggagggtatttttttatagtttttttaaatttttttattgttaatatttttgtttttttatttgaatttttttatatattgttttttaatattgaaattggtgagttttaaaaaataatggaaaagataatttaggagttggaaaattatttttagaaggaaaggtttagggtttagtttggttgaattagggaaaagaaagttggttaggtgggtttgattgttgtttttaagtaggtgaagtgttggggggagtatattaagttagtttttgtagaagattaagtaggtagaaatagttttttggaaagataattaatggtttatgagatgtttgttgggttgttagggtggtgaggtttaggtatgggatattgagggaagttatgagttagtttttagagttttttggggtggaatttagttgggatgttttagatatggagggagttagggtagtttaatgattttttattgtttttttggtaggggatagtgtattaagtgtgtgaaagggagttttttttttaagagaagtagaatttagatttaggtttatttgtgggttttatatggattggtggtgagttttttggttttagaatatgagattattttaaaggttaaatgattttttagggaaatatatttgttttagaatttttttttttttgttttgtaagggataagattaggtttagagggagaggttgtaaataattaaggttatttaggggtttttttgttttgttttgtgtatttttgggggttaaagtttgtttatttgaattttttatttgttgtgttttttattttttgttttttggttttatagggttttaagggtaataggggtgattttattgatgtaagttgtatgtgtttagaatgatttattaattttatgagtttttgatttgttttttttatatatttttttatttttttttaaagtaatgtgtttttatttaaagtattaaagataaatgttgtaagtatatgattttttgttgttttataatgtatatttttatatttgaaatttttatatggtagagtagttttttatttttttttttttttgttttttttttagtttgttgttatggtaagttgattttggtgatttttttttaaggaaaggaagttttttttttgtagtaagtatagtttgtttttaattttttattttttattttttatagggtttttggagtgttttgtttttttaatagaattagtttttgttttagatatttttgagggagttaattaagatatttttggttggatgtgagatgtggttttgagtattgtgaatgatttgattattgttgagagtaattgtttatggggggtttgggtggttgtggttatttataataatgaggtgattatggagatttggtttgttgattttaagaggaagttggtttttttggataagattaagaatttttaggtggttttgatatttaaatagtagagtttggagattgttatgttgtttgtggttaggaatatatttaagtgtgtgaggaatggatttttaatgaggaaagtggttgttttttttagtaatatatttataagagtatttttatagtttagagaggttgtgtttaagtttttagatgtggggattatttttttgttttttataaggtaggaagattggtagtttattaatgttttgtaggtttgtgttttgtgtgtgttgttggtattttttttttttttggggttttgagaaggtttttagatatgtttatgtttttttgtggttttatgttttatagtttttaaaatgtttttaatgaggttatttgtttgagaattttttttgtgaggtttttaggataattttgtggttttagtattatagggatgtttatatgtttgtagtattgtttttaggtttttttttatatgttgatagtttttgttggttagtgatgttagtgttggtgatattttttatttattaataaggtggtgtgatttgtttgttttatttatgaggatttggatgtttgtattttttttgtttttttttaagatggttttttgtgtatattttgagttgtgttttattgtgtattgggtatttgttttttataattggttggtgaggtttgtattattagttttattttatggataggaagattttgttgttagtgaggtgtttgtgagaggttaggattttagtttattagattttgaaatttatgtgttgatgatatttattttagtttttattttgttttaattggttttgaaggtgaatatttagggtggttttggaggtttgtagttttttagtgaggtttttaaaattatgttgatttagtatttttaatttatattatattattgtgtaaagttttttttagtgaggttttaagggttagtttatggagaggttaagtgttgtttgtaattttattaaataattggtttaattgtgtgttttttttttttttttttttttttttttttttttttttttttttttttttttttttttttttgagatagagttttgttttgttatttaggttggagtgtaatggtgtgattttggtttattgtaatttttattttttagttttaagtgatttttttgttttagttttttgagtagttgggattataggtatttgttattatgtttggttaatttttgtattttttttttttttttttttttttagtagagatgggggttttattatattggttagattggttttgaatttttgattatgtgatttgtttgttttggttttttaaagtgttggggttataggtgtaagttattgtatttagataattagtttaatttttatattaattaatatttatttagtgtagttttggtgatattgtttaagatagatgggtgatgggtaggaaggagtttatttgggagttaggaggttttggtttggttttatattttttttatttatttaaagtaatgtgtatgttatttagtgtttttgtgttttagattttttatttgtaaattgagattggggtaggatgattgttaatgtttttttttttatattggatattttatgtttttattatagtttgtgttggtgaaagatattgggttattattgttattttttagggtttgttttgttgaatataggatgatttgtgtatagagtgttgggtttgggaatttagtgttgaagttgggttattggttatgtgtttttgatggggggatttatttatataagtttgtttttgtgtgggttgagggatttagaattatgtgagttttttagtatggttttaatgagattaaaaaattgtttatttattaattatttgtttatttatttatttaaattagttatttgttaaatgaataattattaattgtgtgttaggtatggtgatagataggattttttgtatttattgggagtgattttgttatttgttttaattatatttgagagggtggggaagggatggagtttttatattgttgttaaaaataatgataagattaagtttttattatttgttagaggatatattagttattaatatttattatttaatttaattttttaaatgatattattaggaaggtattattttttattttatagttgaaaaaaattgaaatttatttgaatgggatatgaattttagtttattttagtagaataaaatttatgtttttttattatatttagagtttaattttatttttaaatgagaagatatttttaatattgttttattgggaagttaatttattttattgatgtagttttgatttatttttttgttatatttttagatattattgattatgtatgtttttattaaaattgtttttttgtttaaattagattaataatatagtagtggggtatgtgtttgttttgtttgtagggagagattttatagattttttggagaatgtttttatgtgttatgtttgtttgggtaagttgtttttttaataggaagatttgtttagttgtaattgtaaaatataatatttatgggagagtgagagaataatgatgatttgtaaaaagagtttgagtttaattgatttataaagttttgtatttattagagtaaatattattgtagtagtttttatattaaaaatggattttttaaaatagagtttttttttgatggtggataatttattttataggtaataaaggaggaggtagtttttgtttaagttttgatattagaatttagaatgaaaatattggtattagtgattttttagaatatatttttttaaagagtggtagagaagtaatataattttttattttttttaaaaatgttagtatatggtatgttataaagattttaggttagtgatttgttttatttattaagtattaggtgatagaaattgaaatttggttataattaaattaaggtaagatataaattggttttggttgtgatgttttttttttttttttttttttttttttagatagagttttgtttttgttgtttaggttggagtgtagtggtataattttggtttattgtaatttttgttttttgggtttaagtgatttttttgttttagtttttagagtagtttagattataggtatgtgttattaggtttagttaatttttgtatttttagtagagatagggttttattatgttggttaggatgattttgattttttgattttgtgatttatttgttttggttttttaaagtgttgggattataggtgtgagttattgtttttggtttgtttttgattttatgtgattattttaattgtttaagttttttagtagattgatgagttgtgtattttgttgtgggtgttatagaataaataggttgttatgtttttttttagatatttgtaatattgatttattttgtggatttggtagttggaggtttttttttagggataggagagtggtagggagtgatgtggatattgatatggtttttattttagatagtgttgagattattattttgttttagtttaatgagatgaagaagtatatagtgtatttggttagataattggatatgagtttagattttaaggttttttagtattttgttagagtggtagttgtgtagtatgtgttttttgagtttgtggataatgttagtatgttatttgtgaaggtggaattttttttgattgattatggttttaaggagaagttggtggatttttttagtaggggaatgatatagttgtagggaattagggttttaggtagtgttattgaatatattatagagaatgtttttgaaagtgttttaaatttatgggatttgaaaattgtggttttgatgttgatgggtgaggtgttggagtagtagttggaggaggtttagagagttattttgtaggttaaatgtaagggttatttttttgtggttttgggtattggtaggaaggtgaatattaaggaggtatatatttttgttagtgagttaaatgatgttttttttaaattagtggataagtttattgagtttaatgaggagtttttgatgtgttttgggaggttgttgttattttttgttagtagtaagttttgtgtggtatagtatgtgttttggtttggttttatgtttgggttaggagaagtgtaggaatagttatggaaaagataattgatgtgttgataggaattgttttatttattgaatagatatatattgatatttgttatatgttataaatgtttttaggagttagagtaagtagggaatatgtagatagtatttttgtttttattgatttttttattttattatatttgattaagtgttatttagttataaggtatttttggtgtttttaatagtttataaatgggtgggtaaatggattaaatgtatatttattatgtatgatataataggttggtatgttgtgagagaagtgatttttgttaggggtattggggaaagtttttagaaagagttgttttgattggggtttagttattagttttgtgtttggatattattgggtttttgtttatggggttttttttttttggaatgttttttattgtattttagtagtaaatttatatttatttttaaagtttaattttaatggtttttgtttgttgtggaagttgttgtttttaaggtttgtttatggttaatttggatattttatttagggtatttattatttggtttgttgattatttatttgtgggtttgtggttttttagattgttttttgaggaggtgtagtttattatagtttttagagtttgtgtatagtgtgtagtttagggttagtataggtaaggtttggaatagatgagggggatttataaagtataaataaatatgtatatgttaaatgtttattatttaaggtaatgttgaggtttatgaaaatagtatttatatttgtgaaggtttggtttttaaaagatttaaagaaaaatgtgaagtaaaggtaattttttaggtttatttataggttattgtttttgttttttaaagattaaaaataaaagttttgtttaataaagtattgagaaaatttgaaaagtagttgtattataatttgatgtttaagagtttagaatttgttgaattttttatttgattttttttttatttttgtttttttttttatgttggataaatatatttttaatttaattatttaaatattgttaaatagaatatattggtttattatgttttatggatttaatgttattatattttatgtttaaaattattggatatagtttgtttgatatagttaatttaataataattatgggttaaataaatgttatgtgatttatttaatttgttgatagattaattttaatttttatgttattagtatgtggtttaattgttttttttgttttttttttttaggtgaaaatgttttttatttgtttttagatattaggaaatagtgtgattggttttaaggggattaatttataaagaattttgtgaagtttggttataaataagtgtaagtgattataattattgttttaaaaattgtagtgttgtagggaatgtataggttttttaattattttttgattttatgggatgaggattttgaaatttagaaaatgtgattttttaaaggtaatgtgggttatgttttttaaataatttgttttattagttagtttttgttatgtaataagttatttaaaatttagtggtttaaaataataattatttatttatttttttatttaatttatttagagatagagttttgttgtgttgtttaggttggattgtagttgtgtaattttggtttattgtaatttttgttttttggatttaagtaatttttatgttttagttttttgagtagttgggattataggtgtatgtagttatgtttggttaatttttgtattttttttttagtagagatggggttttgttatgttgtttagttttgtttagaatttttgaatttaaatgatttgtttgttttagttttttaaagtgttgggattataagtatgagttattgggtttggttaataattatttatttaatttgtaattttgtgggttagtaatttttgtttgggtttaattgggtggtttttttgttttttttttggattttttatgtttgtggttagttgtttgttagttatagagttgttggtttagagtggttttagatgggttggtttatttttgttttatgtggttttttatttttagtaggttagtttgggtttgtttattaggtgatttggtagggttttttgagagaagataagtgtgtaaggttttttgtgatttaggttagaattggtatattgttatttttgttatgttttattgattaaagtatgtttaaaggttaatttagatttaagaatggaaaattaggtttgatggaaggatttgttatattatattgaaagggtatgggtagagagaaggtagataattgagattatagttttaaataatttattgtatttggtgtgaaatgattatgtaaaagaaggattggatatattaaaaaatagattttatgtttttttaaaattattaatgttgtgataatatgtaatgatggtaataataggaagttatgtgtatgttttatgaagattgatgggaggggtgggagtgggtaggattgtggtatttatgttgatgttgttgtttggtttatgtgttgtgttttatgttttgttttattttgggtgttaattttaggagtaaagagggtagtgggggtatgtaatagagggttagttggggtgatgtggttgtaagaattgagtttttgtagtgtgttagtaatgtgtgttttttaagagaatgttatagtgtgttatgttttggagggaagtgtagattttgtagattttgaattttgtatatagatgagatgtgaatgtaaatgatttttgaaaaatgattatttggtttatgattagttgatttttaagatggggaaagagagtttatttttttttattgtagatttttttgtttattattatttaagttttttagtttttttttttgattttagaaggagtggttttaaattttagtatagtaagaatgaatattattgttaaggttattaggatttttattgtggtattggatgttttatttagttttgtagtttttatttttttaggttttaatgatttgtattttttttttgaaattttttttgaaattggtttaatttttttatttttaggaaaatagaatgaatgaagtaatttagtatttgaagttttatgatattaatttgaaaatatattaatattttttaggataagtagtaagatatgattataaaataatatatttttttttaagattaagaaagttatgaagtgtgggtttttgttgttatgtttgtttgattaggttgttattttttttagatattggtaatagattaagaaattgtaaaaaaaaatatatatatataaaaattaagagaaataaaaaatatatatatttttagtaataagttttgggagtaaaatagtatatgttaattttataattttttagtttaatatagtatttgattgagtggatatttttttataatgtaagtagttaattattgattttatttaatttttggtgtatgttttggttggttaattgttataatgagaatattgttggatattatttattattgttttttattttttttttgtttttattttagaaattgaaagatgtttttgtagaataatataagttttatttttaatggttttattttttaatatgttgttttatatttttttttagggaggtatagatttttaaaagaaggaatttaatatatgtattgttatatataatttataaaaattattgtatgtattttgttaaaataaatttaatgtagtttatggggttatgtttttatttattttagatagtaggtaaaagtagaggtaatatttaatttgttttaatagaaatgttttgaataatgttattttaagttttatatttaatttagtgatgataatgaagttggtgattatgatgaagttggtgattattataataaagtttgtaattattataataaagtttgtgattattataaattagttatttgtgaagttagttgttgtaaagttggtttttgtgaaatttgtggttgttaagtttgtggttataaagatggttattgttagatttttagtggtggtgaagttagtaatggtagtgaagtttgtagtagtaaagttagtagttgtaagattttttgttgttgttgttgtaaaattagtggtgattaagtttgaggtttttaggttataggtagttaaattagttgttattaagttagttattattaagtttatgggtaagaaagtttttgttagggttgttattttgtgatatttttattttttgttttagggtgtgttttttaaagtttgtatgtaatatatttagaatatagtttttgatttgggtttgtatatttggatgatgtattttaagaggtgttggttagggattttagttttttattttttattttgtgtttttaattttgttttgtgatagggatgggaagtttttattttttttggaatgttagtgggggtatagtttattttatttgaaaattgagttgttttaaattaaagggaaaagtttttgtgttgaaataaggttttagtttttatttagggagtgagagagatagaaagaaaaatgttgtagttggtttttaggtagtaaggtagatgtttttgggttggtgtatggagttggatttgtttattttagaatatgttttgaaaaggtttgggggagttttttgtaattgtaaattttgtttttgttttatatttatagaaaaggggttttaagttgtgtgttgtggtaatattgggtgtttagtttagtagtttgaaaagttagagtttggattattagttattttttaaggtttaaatttatgtttatgttgattatgagaaaaatattgaaagtaatggtaaaaattataatgattttgtattaatttaatatattttagattgaattagatataaaaggtagatggttttaatgagattaagagtatgttattttattatttttttaaagaagatattggaagatattattgaatgttataagttgtaaaggaaggtttatgataaaatggaaattatttttatttgatgaatagtatgagagagaaagtagaatttttttaaaagaattttatgttatattttaaaattttatgatttaatatattttaaattatggggtttattttgtagtaaatataatttaggattagtatgttgtatttttaaagtatttttttaataggtgagatttttaatagaaaaaaaagttgatgaataatgagattttttattattgtgaattttatattttatgtatgttgatagattataagagtaatgttttttaggggtttgaataagaaattagttttttgttttagttaaattttaagttaatttgtttgttaatatattttttttagatttttttttttgtttatgtattatagttatggaggattttattttttatttttatgttttgatttattttttagttaagatgttttgtgaagtttaggtgtttgagataatagagaatagtgttaaattttattgggagagggttgagttttttggtttttatttttatgattttattgttattttagtttatgattagtttttggttttgaagtagaattttatggttatggattgtgttattggaggtttgtttgttgggtagatatattatgtggttgtggtttgttatttgaggttttaggttagagttatttattatggaagttttagtataagtaagtatatgattagtataagttggtatttgatttttatgtagagtattaaataggatataaaggagatatttatttattgaatttattttgaaataattataaatttaaaaaataataatagtaataataataaaataatttagtttgggtgttttggtggtagtttaagtttataaaatatagaatggaaatgggattttatgtgggatgtagttttgttttttgggttttgggttattttttggaggaagttagatttatgttgtttgagtatagttttttttaatattgtatttgggaaagatggttatgttttttggtgagggtttttggttgtttattattttgtttaggtttttatgtttaggaaaatattagttagttattggttttttagggagtaatggaggtgtttttgaagttttattgttttgggggtggaggatgttgatagttgagtttttttgttttgattttattatagttgggttttgtttttggttggttgttgtttttaggggtttttttattttattgaggtttgtatttgagtgttgttatagttttttttaattatttatggtttttttttttatttttttaaatttttttgggttttttttttttattttttttgatttttattgttttaggaatgtgaagggaaggttttttttttttttaggttaatgttatttagattaaggaattagtttgaggaaagggaatttttattagtgttatggattaggtttatagagatatgagtttaaagatttagttaattttagggttttatttttttggatagtagtagaagaggttgtttgggaagtgagaggatttgtttagaagtttagggatttttttttgttgtttattagtttatggatttaatttgtagtttatagtataagttgtggatgtagaggtgttttggatttgtgttttttaattattattttttaatataagatattaattatagtaggtaattttatattagttattaaggatttttaagtttttttgtttttgatttatttatgagttgtatatattttttttttatagagaaattttagtttttatttttatagttagtaaggttagtttttagtttaattattaatttaatggtgagtatagaattattggtttttattgaaataggtgagttgtgaaattattaggtttattaatggtattaagaaaatatttattttgattttaatttaattttttgggttttaagttttagtttaggtatgatttttatgggggaaaaggtttatgttagttttgtgtagtttaatattattttattttgtataattttaggtgtaaatggagttttattttatttgtgattagatttagtgaaaatttgatgggaggtgtttttggggttattattagaatttatgtatttattagatattttttttgtgttttatattgggatttgagttgatttgtggtttgtgatgttgtgaagattggtgttttatttatttagtgatttaatttaataaaaaaattgtttagaagaatataagataaatttggttggaatttatgaaatgtatgggtttggatttgatttatggggtgttttggtttggatattttaagtatatattttagtttagtgtgtgagtttgtgatattgttttttatgtgtttgaattttagagtgtgtgtatagtttatgttaagttagtgattggttaggtgtaatttaggaattgatagttgttatttgtttttgtttttgggtagtgaaattttgagagatttggaattttttatttagtagaatgtggatttggtttgtttattggtgagaaattgattattaaaatagttgataggttttgtttaagagtgtttagtaaagaatgatggtattaatataaaaaatggaaatgttatgggaatttagatataatattgttttatatatttgaagtaaaagttttttgttaattaggggataatttattattttttggtgtattgtttattgttaggaggaggaaagtatttttttttataatgtttatttttgtaattgattttaaaggtgtttgttgagtgagtttgttaggtgattttattatggtgtttgagtttaaagagaagttataaagaatatagtagattttttttaaaggtgtgggttaggatagatttaattttaattttaaagttgttgaaatttgtgtatgttattttttatttattggttaatttttttttgaatatagtgtgggaaatagaaaaattttagttaatttagtgttttattgagagaaaaagatttggagtaaattagagattagagattaataatgagtaaattagatagtaagatttggggatgtttttgatttttttatgtgtggtttaaaagggataagattgtataaatagtgtttaatttatataaataataatgttttttagtaagggtttggttgggttgttttgtttttttttttatatatatatatatatatatatatatatatatatatatatatatatatgtagagagagagagagagatggggggagagagttgtgaggtttagaattaagaaggtgtttttgatttagatttttaatattgagattgtttgtttatttgtgataaagagaaaagagtttttgaaattggggtttgtgttttttttaaggttgtaagtagttgatatagatgaatttaaataaaattttttttttttatattaattggggtataatttttagatttaggatgtgaatgtttttttattattttatgtgtgtgtgtttgtgtatgtatgtgtgtatatatgtatatgtgtgtttttttttttagggtgaagatataaattatttttttttttttttaaaaaaagaataaggttttgtataattgatttttgattttttaaatttaatgattttatagtaataaataagtatttaatttgttttggtttgatgaatatatgttggtgtatatatagttatggtatttttgagagttttttttgaattattaggttggtgtgaaagtaattgtagttttgttattgatagtaatggtaataattggaattatttttgtattgatttaataaatgggatatttatttaaaaatgtttaaaatttaaaatggataattagaattaggagaggaatttttattttttttatttttattaattttttttttttttttttttatttttttttataattgttattttaattattttttttggggtggggggaaaattttttaatggtttttatatatttggatataggaaaaggagtgataatgaattattttttattaaataattaaaaaaagataataattgtatgtttatttagtagttgtatgtatattttgtatttaaattttaatgattatgatatgtattatttttttaaatatatattttttagattatttaggtaaaatgaagttttaaaaatatattttttatatttatatgtgtttatttttattttttttattttttgtagtatttattaattagaaatatgtttatagagatgggttttttttttagtattaaatagtagatgttattgtttgtttttttatttttgtgaataaaagatgttgttttaagaatttgtattttttatagtttattatgttagattttgggaatttggtgatttgtgtttgaatttgtgaaggaatttgtaggtagaaatattttgaaatgaaaaggtttttagttttgggtatttaaggtaggggaagaggagaggattagtgttattattggtttttgtttgtatatgttaatgtttgtttattttgatagttatattgaatagatgtttgtttattaggaatgtgagttaggtatgtaatgtgagggtagtttggttggggtattttttgttttttataagatttggttttgtttggtatgtggtagggagatttttgtttttgagatgaaggttgattttgttaataggttttgattttattaatatatttagggtattgttagtaattatttaggattttagttttataatattatatgatttgatttttagtggttaatatttgtatttttttaaataaaattaaatgaatttttataaaaatattttattttattttttgttttgtttggtatttaaaagaattatgttttagttatttttttgttatatatttgttgtttgtaaatggtagtgagtagtagtggattttttatttgttattgtggttttttgaaagtatgggtgtgttgggtttttttgttatttgttttgttgttgttgattttgatagtgttatgtagttgttaattttggttttaggtttttgttattattttttttttttttttttttatttttagttaaggaagttttggatagatattttttatgtatattattattaaagttaagattgtttagaatttttaaataataataataataataaaaatttaatttaaaatttattttttgtagtattgtaaaatgaattttaaattattggtttaattatttgtgttaaagaagttttaatgtagaaattagataaaataattaataaaattattatgttttttattatttatttttgaaattagtaatttgtagaattgattatattttgtttgagtagatatgattgggttaattgtatagttttgaaggaattattattttgtgtttattaatgttttatttattgattttaagatgtataattttttttttattgggatatttttgaaattgaaatgtgatttagaattgataatatattatggtttattggtagtattttgtgttatttagtggaatataaaataatggtgtattataaaattaagagtttttatattggatataatatagtatttggttggttatgttttatgtgaatatatattattaattagtataaaatggtatatttgggggaaatatttgattttatgttaataataatttaaagaataaattaattttatagttgaagtaagttaaatagttatagggatttaggaaatggttttttttaggttgtttgttgtttattgttgtgtgaggatgttttttggttagttgttatgtgtgggttatgatgagtttaaaggagtgttttttattttgaagttttaaaaaatagaagtttgttggttaagatttgaaagagtaaaatttaattatagttatattttaaaataaagttaaaaattggttgggtgtgatggtttatgtttataatttttgtattttgggaggttgaggtaggaggattatttgaggttaggagtttgagattagtttggttaatatggtgaaattttgtttttattaaaaatgtaaaaattagttaagtatgatggtttatgtttgtaatttagttattgaggaggttgaggtaggagagttatttgaatttgggaggtagaggttgtagtgagttgagattatatttttttattttagtttgggtaatagagtgagatttagtatttaaataagtaaataaattaagtaagttaaaaatttggtaagtttttttggtattttttgaattgattaatgtttaaaatgtagatggtggaaagtgtttttatttaggtaaattatatttgtatttaaggtatggaagtattttatattgtaataataatgttgagtgagaaggtgattgaatttttttgttttggggattattaaattgatgaggaatatgttgatgattgtagtataaatattttttagtttgtttttttttagtttgtttaaggaagtatttatattgtgatttggaaattaatatgtttgggaaatgttaaagttgatgtttttaaaaatgtattgaaatattatgggaatattaaattatgaaaaagataagattttttaattaatatgttttttattttgaagaatatatatattttttgttgattataaagttaatagatatgtattgttaagtatttaggaggtatagagaaatatattatatgatttttattgtgatagtattgttggtttttgatgaaaattaatagtgatttgatgtatagtttttttatttttttttatgaatattattgtttgtgggaaggtgtatgtattgtatatgtatatttatttttgtatattattattataaaaatggattgtggggtttagggtgttttgtgttttagtgtttttgaatggttgtttttaggatgttttaggtaggtatttgtggtttttgggaataggtgggatttttagaatagggttttaatttaatattgtgtttgtttttatttttttttttttatttggttatttttttgaagtttagtgattaatagtaaggaagttttagtagatagtggtttgagttaggtagttttttttttttttgttttttaagtaaatttagttatattggtattttaggttaggaagttggggaaggttgtggataatttttagtttttattgttttttaggtttttattaggtttttaataataaagaagagtaaattaaggaagatttagttatgtgttttttttatataaagagaaggttttagttttttataggttatatttggggggtagattgattttagagggaaaagatgaataattattgtatttaaagatgtgttgttttagggaaaagtttaggttaagtttaatgagggttagttattttttttggtattttaggatatttaaatatttttttttttttttgttttaaaatagttgttttaatatatgtatttatagttgagtagagtttagttaaaatgatatgttttagaagttaagattatgtggagtttgtattagaagtttttttaagaatataaaattttttgtttttatgttttagaagtagagaagtataggtttttgtttttgaatagtgttgggtttttattttattaatatattttttttggttttttaaatatttttttgtttatagtaatagtgtttttattttttattagtaaattttatagggttttagtagtgatttttattgaaataagggtagaaaatattagtgttgtggtgtggaattggagggttagggtggagggttaaggaagttggagaagttaattagatggggagtggagtgtgttgttgtgaggttatttatgggttgggtgtttgtggttttgggtagattttttgtgattggtttagtagagtttaggggattgggaattgaatagttaaatatagatggttaggattgaagtgtatttgaaataaataaaatagagtaaatagggtttattggttaatgttttgggaaggaaggaagaatagggagattatttgatgttggttttatgttaatagggaagttattagtaaatgaggaataaattttgatggttaaattattttgttttgttagttttttttaggattttttttgatagttaggtatttttttttagttattggtatatttgagagaaagaaggttgtttttgtaaattgtttttattttattttgattttttggagtttttaaaggtttttgtggggattattggttttttgggttttgagagtgtttgtaattaggaggtgttgtaattgtggagttattagttattagtttggaatttgggtgatagtagtaattaggaaatgttttagattaattttgagttttagttttgtgtatttttgagtttggtttattgtgggtgatttaagttatgattatttattgaagatttaggttttttttgttttttttggtatttatttgaagtatagatgtttattatttttgtagttgtgagtagtttgttttgttggggataaaggagatggagaagtatttttttgtaggggagagttggataattttagtttgttagttatttataggaatatgtagaattattggttttagggagttttggagaaagaaggtttatgtttttaaatttatagataatagttgatattaatgttttttttttttagaataatttggagtttgttagaaaattttgtaaataggagttgtgttgtgtgtgaattgtaaatttttttttttaggtgttgaggggatttttgttttattttgtagttgggttatattagatgtgtgtattggaaatataaatttttttaattgggaaaagaatgtttttttgtttttaaaatagttttgttatgtgatatttttgttattatgaattttatattagtgttagttttttgttttatgtgttttatttggtaggttataaaggtttttggttattatatatatgtgtatatatatatatatatatatatatatatatttataaaggatttttttttttgttttatttttaatttttagtttatttggtttgtaatgaaaggtagagttttatttttgaattatattttaatagaattgaatttttattttgttaagaattataaaattttgaggttttaaaatttagttttttttttggggatttaatatggaaggatttggagggtaaatggtttagtgattggaaaggggaaaaataatttattttatttaaaattatttaataattattgttagtatttgggattttgagtgttgtttatgaagtttttttattgatataattttatttattttttataaggttgtaagtaatttttatgtttatatggtagtgaggaaatggagatttgagtaggttaagggagtttttatttggaagttttttttttttttttttttgttatagtagggttattagattgttagttttagtattgggagttgagtaatatgtatgtttttattaatattttttttttatgtttttattaaagatatatgtaagttgttgaaagatgaaggaatttgtagggattttatattaaaatggtattatgatttaaatattaaaagttgtgtaagattttggtatggaggttgtggtggaaatgaaaataaatttggattatagaaagaatgtgaaaaggtttgtgtttttggtaagtgatttttttttgtgtttatggtttttgtaaataagagatttaggttaataagttattttgaaaaatattagaagtgtaatgattatgatatatgtgaaaaagaagataaagtgtatttttagataaggaagatgtttaaatataatttatgaaatgtttttttgaatttttattttgggtttttaaaaatatattgttttttgttattttttagaaatgttattaagttgttgttatttgtaaaatattgtattaaaaatgatttttgggaagataatataatgaataattatagataatgttaaagataaataatttttataaatttattttttaaatagttttgttttttataaataataatgttgttattggggttatttagtatttttattatattgtgtagtttaattggtaataaaataaatattttgaatagagtttggggttagtgttagaatggggagagtttagtttgtataaaggtttggtagatggtgtagggtaaaagaatgggattagattttttagatatttttgggttttggggttttaggttaagaatgttatagagggtttttgatggtattgagtagaaaagtgggataggtgatggaaattagaggttgtgggattgtgttatgataatgatagtgtttttttgggttagtaatgtggttttttttttttttttttggttttttattttattttatttatttttttttttgatgtttagtgtttgttaaatttggagttattagtgtgatgggaatttaagtgtgggtggttaatattatatattttttgaagaagaaggagttagttattgttaatttgtttttgtagaagttttgggtgtagatttttttgtattgtattattttatgttttgatttatatttgaatttgggagggaatattttgttgtatgatttattagtatggtgttaatgtgtttgtggatttttgttttttgtttttaggtagtttttttgaatattttgaatgttgtgtaatagttagttattgttggtgtttatgtgaatatttttattaatttaaattttttttggagttttatgttatgtttgttgtaggtaaatgtaaagtttagaaaataatgtaaatgttatggttattttatatatttttgtttggtttatttttttttttttttagttaagtatgattttagatgggaagtttgtgtattgtggagaaataagagattaatttttttattttttgtttttaattttttagattagattttaagttaattttttttttttgaagtttttaataaatgatttagtttagaaggaagtaaaattttttaatttatgtgtattgttgggattaatgttttaattaaagaatttaaaaaagttgtaatagagaatatttttggtatttttttaatgttgtgtgttttttttttgtgtgtgttggagggaggggatttaattttaattttaaaatgtttaggaaatttatataaagaaattttttaataaagtatattgaaagttttttgggtgtgatgtttttggtagttttgtttttatagtagtgattgttagaattatttttaggttggggaaattgggtttggttttggttttatggagttgtgtaatagttttttgtttttagtggaggaggtaaaagagttttattagttagtgtgtaaagagattggttggagataagtattttttgttttgtggatt

SEQ ID NO: 72 - DNA, 11378 bp, Homo sapiens
tttgttataatttagtaaggtaagtgttattaattttgaatttgttgtgagtattaagtggaagtggatgatgttagtgtataagtagtgattagtaaatgttggagtttttgtttttttttttgttttagtggtggaggtgggtaggatttgtagtttagaaaagtttatattgtttagggatagaattggaattagagtcggttgttttttgttatttatgtttttttatttattagtttgatgatttgtttatagggggagttgagaagcgcgagttttcgttttttggagggatatgtgggttgttgaaggagttaagatgttttttattaaattttggttttttttatttttgtatttgtttttgtggttttaatgagaaatttaggcgttttataagagattgtataaataatttttagggcgttattaatttatttagtagaaagggatttagggttgttaatgttttagggaagataagtgagtggaaaaaaggtggtttttatagcgttaggcggatcgaaggatttgcgtggttgagcgtgaatttcgtttttgtagtagagttgaaaaaaattaggattcgggttttttagtttttttttataatatttgattaggaatttggggcgggattttggtttggtataggtacgtatatttttagtagatttttttattttttttttttttttttttttatacgttttttaatttaaggaggttagatagagggacgtggttattttttgaaaagtttaatttgaggtaagtatagtcgttttatttcgggtttgtttttagtagttttttaaaagaaataaaggaaaagtggtaggggataggggagatggggaggtagggagggtttatttttttttttttatatttgggttatgattttagggatgttggagagtggtagagagggtgtataagggaggggttttagttttgtattttttttttatagtttttttatgggtgttgaggggatttttaatttttaggtatgaaaaagtgaaggattttttgtttagggaagttttttttttgttatttataaattttattatgttgggagtgtgggtattttgaagggtattttaagatttggatgtttttgtaattttttttatagaggggtttggtatataaatgttattatgggagagggggaaatttttgtgtagaatgtgtgtgtgtgtgtgtgtgtgtgtgtgtttggagtggaaaggagagaataaaaagaagtattgagaattggttatgtttagggagttgtggattggggtggggatgtaatttaggtgaggggatggtttttggtttgattttttttattgataggagggagagatttttttttagagtggagaaatgaaagaatagtagtagtttttgagtaaattttttttagttgatagtgtggtagttttggaaattttcgattttatagaaattttgagtataggagggtttttagtattatgggaaatagtgtaagattatgtaattttgaagtaatattgttaagagatgggatggggtaaggagaggtataagttttttattaaatttttttagtatttatggttttaagaagaggttgaagtgggtagggtgtatagtttttagaaagttgagtttgaaggggaaggtggtttttgtttgttaaggtgtttagtttgaaagaaggagaaacggagatagaggtttattgtgttagttttttagatagttattttggttttgtaatagtttagggttgtgtatggaaaaatgttttgttggtagtgggtcgttttattcgtttttttttttggttagagttaggaattagttagtttgtttaggtagtgggtagttgggttagtttttttaaaatattgtggttttttgtttgaggtttgaggttgtttgtggatgagttagggtgtttgtttttttgtaatttaggaattgatgggatgaagtgggtttaaggaaattgttttgaggggatagagaggtttgggatggatggtggttaggaggtaattttgttgagtgttatagttggggttttttttattagtttattggatttgatgatgttggtttttatattttttttttttttttgtttatagttgttaattttagtaggtttaatagtaatgtgagggttgtatgtgatttttttaggttaagaaagattttaaggtttttttgtttaagggtgatatttaggaagatgtttattgtttataggagtatgttatgtattggttataggtaattagggtagggtatttaggttatttttagttttttattttttatatttttagttttttttttagatgatattagatttatattttttttttagtttgttttgtttttattttattagtataataggtttaaaagtaataggtttttagtaatgtggggatttagatatagagtttggttatttaggtgttatcgttgggagtaggtagtttgggaaaggagaggagaatgttagggttttattttaagttgtttttttttgagtatatataagagtttttaatttttagttatttttttggtgttttttatttattttttttggttttatatggtttttgtatgatgtttatggtggagtatgaggagtgttaatattttattaggtattatggaagagagaagtagattaatttagattttatatattgagtatttgttttagaaggtaagtgttatatttagtgttagggtttttagtttggaaaggatttgtaattgttgtatgaagattttgttttagttaagttgtatgtgtagttataaattgttaattagtgagtttttttatttagtagattgttatagatgatggtattttggagggtaatttgagttttgtggtggttgtagagggattatatttttttttaaatatttaagattaaaaatttttagtttgtttaagagattaaaagattttttagatgtagtttagtttttttttttcgatgcgttaagcggtttttggaggttttttattttagggttttttttttggatttttagaaaaatattattttttcggaatatttaaattggatttgggtttagatttgaagagtattttattattatttttattattatattataaatatagggattgttgtgggttttttagtttttttataggatttttagagtgttagaggtttttaagaatttgtttttttaaaaaaaaaatgtagttgtttttatttaaagatattttgtttgtgattttatgattaggggaaaatgtatttagtttattttaaatagttatggttcggttggattaagtgtagaattagattgggaggaggtatcgaagaaatgagagtaaggtttttgtttttagatgtttgatatggaagttagttttgtatagtttaaagtttaaggtttgtttattttgttttattgtttttgtggagttttatttatgttggtttgttttgttttttttcgttttttgtagagataaaatgtagtggattttttttttgttgttggtagggttttttttttttttttaggtttagtatgaagatgatttttattggtggttttattattttcgtagttagtagtttatttattacgatttttatgatttttattcgtatgagatttacgagttttatttttatggggtggatgaagggttagtttatatttacggttttttattttttttagattttcgcgattgtttttaggagtgcgattgtttatttaatttttttacggttatgtattgtgataatcgtaattttaagtatttgtttttcgttttttttcgtatgaagtatgtgtatttttagaataattagattatttttatttaggaaggcgtttttgataatgttatagggttgttttggattgttttttacggtaattagattattagtgataaggtgggtaggaaggttttttttaagttgaggtatttggagaggttgtatttggattataataatttgattcggatgttcggttttttgtttcgatttttgagagagttttatttcgattataattagattttacgggtttttaataatgttttggaggggttggagaattttacggttttgtatttttaatataatgagatttaggaagtgggtagttttatgaggggttttcggttattgattttgttggatttgagttataattattttcggaaggtgtttgatgggttgtttttagtttttgagtagttgtatatggagtataataatgtttatatcgttttcgatagttattttcggggggcgtttaagttgttgtatgtgcggttgttttataatagtttaattaataatggtttggtttttaatatttttaattttagtagtttttttgagttagattttttttataattagttgtagaagatttttttagttaatattaatttggagaatttttatttttaaggtaataggattaatggtgagattttggtaaagggaggcggggattggttgtttattttatttgaaagatattattttgagtgttagtggtaaaataaaagaaatagaaataggggaattagatagtataaatgaagtaatttgataattaagttatatttttgtataaaagagaatatatttatattaaatagtagtgttaagataatttagtggggagtgggttggtatagaagaagattttttaggagaggtaagttttattttaggttttgagagataagtgggtatgggttgggggtatgtaggatggagatattttgggatagaggtttgttataaaggagttagttatttttataggttatttgtcgatgtaggggatagttgggaaatgttacgtgtttgagatgaaggggttatgtgttagggagtagtaagagatgagttcggagaagtttaggagggaatattttaaagggagggagatttaagtttagtttttaaagtttgttttaggagaatggtgggttgaagttttgtatttatttattgttttagaagaggatgagttttttttttttatttgaattatttttgcgtttatagtttggttttgtgttttggtgtttatttttagagttgaatgcggtatttgttttggttagttttttttggagtataaggattttttggtggtagggtagatattttttttagggtaatatgagtttgattattattaagtttaggatattgggttttttgttttataagtatttttttgtaatgtttaaaggaaaaaaaaaaaggttgtttttttgattttaagaaatatttattttagatggaattatttagttgatttttagttttttttagttttaggatttagtatttagaatatgtttatattattttagggtttttgatgttttaattttagttggaaggtattgagttagtatttgatttttttttttgttagtaaagtttttttttatttggagaagggaggatttattaacgattattggtaaagggttttgaagtggagtttgttgagatagaatcgtattattaaagcgttgagaagaatagagtcgttatttttttttttttattttttttttttttgtgtttagggaatagattagttattgagtaagatgttaataagttgggtagttttttgagtgagagaggtattagttttagagggtaatttgggagttgatagtcgggtgggtaaggtaaagaggtatttgtttggtatttttagtttgaagtgtttgatattattatgtatagtttaaatttttttttattaaaatttttttttttttggggtttttttatttttaaggtggggattgaggggttttttaagacgtttttttttttttttttgagatagagtttcgttttgttatttaggtcggagtgtagtggtatgattttagtttattgtaaatttcgttttttgggtttacgttatttttttgttttagttttttgagtagttgcgattataggcgtttgttattacgttcggttaattttttatatttttagtagagacggggttttatcgtgttagttaggacggttttgattttttgatttcgtgatttgtttgtttcggttttttaaagtgttgggattataggtatgagttatcgcgtttagttaagatattttgaagatgttgtaagttgtagacgtttgatatttttttgtggttgtttattattatattagtagttattattatttatttgttatatattttgaatttaggagtagttatattagaaatgttatacgtatgttgtgttttatttaagtttgattttgaaattgtgatagtaaagaatagttgttatgggaaagaatttattagtatttatttatataattagagaaagttgggatggaaaaggttttattataattttttattatcgttttgtttttatgtagaattatatttgttatttaaatgggaggtggattattttttttagacgtttgttagaaaataaaattagtgtagttttttaaggtttcgtaaataaattttttgtttaaataatttttaaattttcggtgtttatttttaaattaatttttgtgtaatttaagtttaagtttcgtgattaggtattatttagttttttttagttttttttttagataaaataatgttttattttttttaaagtagtgaattaatatatgtaaagtgttttgtttagggtttggtatagaatttaaaaattaatgatagttattattattagtttttttttttattgttattttaaagttgataggtagtttttgttgttgttttggggaaaaagagatatagagaaggtaaagttattttttaaagttttttagatgatgtagattagaattttgatttaaaggatttagagttaggtattttcgattgagaatggtgaggaatatttttttgatgtagattattagtaggaaaatagttttttaagtttagtttttttttttatagtaaacgtgagggatatttttttgtaaattagttagggatttggggatggggggtgttggaggtgggattgaaataagtttttgagagaggagtttaaagaagaataggagtttaggggcgtataggggaattagatgtggtttttttttcgttattttttttttttattagtattttttttagtttttttagtttggtaagaatatagtttagaatgttatttagaagttttgggatttagtggagtagggcgggtatattagtaggaatttggaaagatttatgttagtatttaatttgggttagaaaaatgttttttagtgtttttacgtagaagtttgttttatttatgggtttggggaagacgggggggtgtttatagtatttagtatgtggttagagtttatatatattgtgtgtttagttttttataggtatgttttatatttatttatttatagttgggatttggaattttagtaggtagtttgagggttttaggttgggaaagaatttattacggagtttgtagttttattttaagtagggttggaaatgatatttaagttgagttattttgttttttttttttattttattgttttgtttgtatatagataatatagatttagtttcggtttaggttttgtttttaatttgtttatttagaggttatttaatttagtttttgggattagaaaggaaatatttaaaagtattttagaaattttattttattaggagtgttttttaaagacgagtattttttagttttcgttattttttttagtgtttaattttttttaggtttagattttttgtgttatgtttgtaatataagttaatttgttgtaattttattttattttattttggttagtgtttaatagagattgaaaattattgaaaatgttaatttaaaaatattttttttattagtttttttaagttttttatgttgttttttttggaattgttttttttatatttataattttttttaaggggagtttttatggttatatttaagaatagagttagaaaagtattttttgtttttatttttcgtgtttggttttagattgacgtattttttgattattgttgtaagtcgatggatgtttttggtataatagtaagttttagttttgggtttatttaagtattatagttgttagggatgtgtttatggataattttatttttaagatttaatgggtaattttatttaaattttttttgtagagaatgataataggagtaagttttttgaaagttttatttattatggtaaagatagttttacgaggtttttttagtttttaatggtgatttttgttattttttttgaagttttagttgagtttttggtttttttttttaagttattgatttagtagattggagatagagtggttgatttgttaaagaggataattagagggataatagggttaatagtaatagaaagatttatgttaatattatttaagtagaattattgtttttattagaattttgcggtttaggggaaaattttaggagatttttttttaggtttaaaaaagggagtagattgtaattatattaaatgtaggaggtagggaaattatttatttgatttttgaggtttttagtagttttagtgttttatgagtttttagttttttttaaatttagagttttgtttattgttttggtagtatttagaatggagacgtgtaatttatttaaagttttggtatataaagatatttgtttttcggtttaggttttttttttttaattttttgttattttttttatttgtaaagtattaagtttttttatttttttagtttttttttttatagtaatttagtaaagttttttttttttaaaaataattaagtattttaaggtgtttacggttggtttttggttattttttgttttttattgttgtttatagttgtttatttgtttttttattttgttaaaaaaaaaaaaatgttttagagggaaggacgtttaagaatatttttgggtttgtagagtaaagtttaggttggtggttaggaggtgagttgtagacgtaggtatagtttttattttgtttttagttttgtttttagtggcgttagtaagtatgattttaattttggaaaatatttgttttttatttttaatttttatttttttatttaagttgttttataaaggttaattttattgtggttttaggttcgtaatttgggtttttttttttgattcgtgttttttttgtttttatagagttttttattagtagtttttgtatcgtggtggacgtcgtgaatttttttaagttgtaggtgttgcgtttggacgggaacgagattaagcgtagcgttatgtttgtcgacgcgtttttttgtttgcgttttgttagttttatcgagatttgagtagttttggtatcgggtattgggcggagagttttcgtggtatttggtttgatggtttggtttggtttttgttggaaggtttaggatggattatgtgatagaagtttacgggtattttttgtagtttttttttttgtaggtggggttagggggggcgattagggataggtagttttttgttgaggatataggtagaagtttatttttttttagggatagaagtggtggtagatggaaggatttttggatgttttaattttataaattttacggtttttaagttttttttaatgatttgaggttatggaattttaaaagtggtatgggtaatagtatataattatatttttttaataatttttggttgtttgtgagtagtatttgatagttttttttttgtgttgggttggtcgtgtagttattttgggtttttatttgttgttttttaaaatatattttttgtttagttgttttttttgaaatttattttatttattttatttttttttatagatgttttttttgtgttttaagtagagttaggagattttaaggtatgtgagtatttgtttagtaatttgtggagataatttatattgtgtttgagggtgaaaggatattaggagttatttttatatttttttaattttatttttggaaagttattagattggaggttattagtatgatgataatatttatgatttgatgtgggaggagatagttaattttaggtttagattaatgtatagggttatattttggtagttgggtagttttttgaaggtggataagattttagaagaggaaaggttagattttgtttattattagtatttgtaatgggttaaatatattttaaattggttgagttgagaaagtagttttagtagttttatttttgtttagtattttttgtattttaaatagtattttatttgggtttttatttataaaggtagcggttatatggtttttaaagtatgagaaatatagtttgttttttttttttatttaagtaggaagattttatattttgatggtagagatagattttaggtagttttggatttgttagtttaaagaaggaggatgtggttaatttgttttatttggtttgttttaaggttatagttaaaaagtattagttttggttggggttcgtgaagtttaggttaggtagttaaattttgtttgtgttgggtatataattttttgtttttatatttttgagttatatttttattagtgaaggtggtttttgttttatagtttggttggggagtatttaattttttttattttaaaaggtaatgttgtttggggtttaatttatttgttttttgggtaaggttgggataaagttatttgggtagttaggggtaaggattgttggaggagagttagtttaagtataggttttgtttagatgttattatatttttgatattgtgtatgttttgaagtattttttttgagaagggaagaggggatttttggattacgtttttggttttagatttggaatttataaaagttaaattagtttattttaataaaggagtttcgatgtgaggggtaaggttgttttttgttttagggttttttagaaagtatttgtatgtgaatattattatgtttttataaaggatttttattataggaaaagtatgagtggtggttaatttgattaataaagttattttatgattgtatttataagagtggagttatttaaagtagattgtaggagggttattttaggaggatttggtgaggtcgtaggttatataggttttggattgatgagtttttttttttatttattttgttcgggtagatgaagttaagaggaaaaaaaaatgaaaaaaaaaagttatttgtataaaagttgtagttagtaaattgtgtttt

SEQ ID NO: 73 - DNA, 11378 bp, Homo sapiens
tttgttataatttagtaaggtaagtgttattaattttgaatttgttgtgagtattaagtggaagtggatgatgttagtgtataagtagtgattagtaaatgttggagtttttgtttttttttttgttttagtggtggaggtgggtaggatttgtagtttagaaaagtttatattgtttagggatagaattggaattagagttggttgttttttgttatttatgtttttttatttattagtttgatgatttgtttatagggggagttgagaagtgtgagtttttgttttttggagggatatgtgggttgttgaaggagttaagatgttttttattaaattttggttttttttatttttgtatttgtttttgtggttttaatgagaaatttaggtgttttataagagattgtataaataatttttagggtgttattaatttatttagtagaaagggatttagggttgttaatgttttagggaagataagtgagtggaaaaaaggtggtttttatagtgttaggtggattgaaggatttgtgtggttgagtgtgaattttgtttttgtagtagagttgaaaaaaattaggatttgggttttttagtttttttttataatatttgattaggaatttggggtgggattttggtttggtataggtatgtatatttttagtagatttttttattttttttttttttttttttttatatgttttttaatttaaggaggttagatagagggatgtggttattttttgaaaagtttaatttgaggtaagtatagttgttttattttgggtttgtttttagtagttttttaaaagaaataaaggaaaagtggtaggggataggggagatggggaggtagggagggtttatttttttttttttatatttgggttatgattttagggatgttggagagtggtagagagggtgtataagggaggggttttagttttgtattttttttttatagtttttttatgggtgttgaggggatttttaatttttaggtatgaaaaagtgaaggattttttgtttagggaagttttttttttgttatttataaattttattatgttgggagtgtgggtattttgaagggtattttaagatttggatgtttttgtaattttttttatagaggggtttggtatataaatgttattatgggagagggggaaatttttgtgtagaatgtgtgtgtgtgtgtgtgtgtgtgtgtgtttggagtggaaaggagagaataaaaagaagtattgagaattggttatgtttagggagttgtggattggggtggggatgtaatttaggtgaggggatggtttttggtttgattttttttattgataggagggagagatttttttttagagtggagaaatgaaagaatagtagtagtttttgagtaaattttttttagttgatagtgtggtagttttggaaatttttgattttatagaaattttgagtataggagggtttttagtattatgggaaatagtgtaagattatgtaattttgaagtaatattgttaagagatgggatggggtaaggagaggtataagttttttattaaatttttttagtatttatggttttaagaagaggttgaagtgggtagggtgtatagtttttagaaagttgagtttgaaggggaaggtggtttttgtttgttaaggtgtttagtttgaaagaaggagaaatggagatagaggtttattgtgttagttttttagatagttattttggttttgtaatagtttagggttgtgtatggaaaaatgttttgttggtagtgggttgttttatttgtttttttttttggttagagttaggaattagttagtttgtttaggtagtgggtagttgggttagtttttttaaaatattgtggttttttgtttgaggtttgaggttgtttgtggatgagttagggtgtttgtttttttgtaatttaggaattgatgggatgaagtgggtttaaggaaattgttttgaggggatagagaggtttgggatggatggtggttaggaggtaattttgttgagtgttatagttggggttttttttattagtttattggatttgatgatgttggtttttatattttttttttttttttgtttatagttgttaattttagtaggtttaatagtaatgtgagggttgtatgtgatttttttaggttaagaaagattttaaggtttttttgtttaagggtgatatttaggaagatgtttattgtttataggagtatgttatgtattggttataggtaattagggtagggtatttaggttatttttagttttttattttttatatttttagttttttttttagatgatattagatttatattttttttttagtttgttttgtttttattttattagtataataggtttaaaagtaataggtttttagtaatgtggggatttagatatagagtttggttatttaggtgttattgttgggagtaggtagtttgggaaaggagaggagaatgttagggttttattttaagttgtttttttttgagtatatataagagtttttaatttttagttatttttttggtgttttttatttattttttttggttttatatggtttttgtatgatgtttatggtggagtatgaggagtgttaatattttattaggtattatggaagagagaagtagattaatttagattttatatattgagtatttgttttagaaggtaagtgttatatttagtgttagggtttttagtttggaaaggatttgtaattgttgtatgaagattttgttttagttaagttgtatgtgtagttataaattgttaattagtgagtttttttatttagtagattgttatagatgatggtattttggagggtaatttgagttttgtggtggttgtagagggattatatttttttttaaatatttaagattaaaaatttttagtttgtttaagagattaaaagattttttagatgtagtttagttttttttttttgatgtgttaagtggtttttggaggttttttattttagggttttttttttggatttttagaaaaatattatttttttggaatatttaaattggatttgggtttagatttgaagagtattttattattatttttattattatattataaatatagggattgttgtgggttttttagtttttttataggatttttagagtgttagaggtttttaagaatttgtttttttaaaaaaaaaatgtagttgtttttatttaaagatattttgtttgtgattttatgattaggggaaaatgtatttagtttattttaaatagttatggtttggttggattaagtgtagaattagattgggaggaggtattgaagaaatgagagtaaggtttttgtttttagatgtttgatatggaagttagttttgtatagtttaaagtttaaggtttgtttattttgttttattgtttttgtggagttttatttatgttggtttgttttgtttttttttgttttttgtagagataaaatgtagtggattttttttttgttgttggtagggttttttttttttttttaggtttagtatgaagatgatttttattggtggttttattatttttgtagttagtagtttatttattatgatttttatgatttttatttgtatgagatttatgagttttatttttatggggtggatgaagggttagtttatatttatggttttttattttttttagatttttgtgattgtttttaggagtgtgattgtttatttaatttttttatggttatgtattgtgataattgtaattttaagtatttgttttttgtttttttttgtatgaagtatgtgtatttttagaataattagattatttttatttaggaaggtgtttttgataatgttatagggttgttttggattgttttttatggtaattagattattagtgataaggtgggtaggaaggttttttttaagttgaggtatttggagaggttgtatttggattataataatttgatttggatgtttggttttttgttttgatttttgagagagttttattttgattataattagattttatgggtttttaataatgttttggaggggttggagaattttatggttttgtatttttaatataatgagatttaggaagtgggtagttttatgaggggtttttggttattgattttgttggatttgagttataattatttttggaaggtgtttgatgggttgtttttagtttttgagtagttgtatatggagtataataatgtttatattgtttttgatagttatttttggggggtgtttaagttgttgtatgtgtggttgttttataatagtttaattaataatggtttggtttttaatatttttaattttagtagtttttttgagttagattttttttataattagttgtagaagatttttttagttaatattaatttggagaatttttatttttaaggtaataggattaatggtgagattttggtaaagggaggtggggattggttgtttattttatttgaaagatattattttgagtgttagtggtaaaataaaagaaatagaaataggggaattagatagtataaatgaagtaatttgataattaagttatatttttgtataaaagagaatatatttatattaaatagtagtgttaagataatttagtggggagtgggttggtatagaagaagattttttaggagaggtaagttttattttaggttttgagagataagtgggtatgggttgggggtatgtaggatggagatattttgggatagaggtttgttataaaggagttagttatttttataggttatttgttgatgtaggggatagttgggaaatgttatgtgtttgagatgaaggggttatgtgttagggagtagtaagagatgagtttggagaagtttaggagggaatattttaaagggagggagatttaagtttagtttttaaagtttgttttaggagaatggtgggttgaagttttgtatttatttattgttttagaagaggatgagttttttttttttatttgaattatttttgtgtttatagtttggttttgtgttttggtgtttatttttagagttgaatgtggtatttgttttggttagttttttttggagtataaggattttttggtggtagggtagatattttttttagggtaatatgagtttgattattattaagtttaggatattgggttttttgttttataagtatttttttgtaatgtttaaaggaaaaaaaaaaaggttgtttttttgattttaagaaatatttattttagatggaattatttagttgatttttagttttttttagttttaggatttagtatttagaatatgtttatattattttagggtttttgatgttttaattttagttggaaggtattgagttagtatttgatttttttttttgttagtaaagtttttttttatttggagaagggaggatttattaatgattattggtaaagggttttgaagtggagtttgttgagatagaattgtattattaaagtgttgagaagaatagagttgttatttttttttttttattttttttttttttgtgtttagggaatagattagttattgagtaagatgttaataagttgggtagttttttgagtgagagaggtattagttttagagggtaatttgggagttgatagttgggtgggtaaggtaaagaggtatttgtttggtatttttagtttgaagtgtttgatattattatgtatagtttaaatttttttttattaaaatttttttttttttggggtttttttatttttaaggtggggattgaggggttttttaagatgtttttttttttttttttgagatagagttttgttttgttatttaggttggagtgtagtggtatgattttagtttattgtaaattttgttttttgggtttatgttatttttttgttttagttttttgagtagttgtgattataggtgtttgttattatgtttggttaattttttatatttttagtagagatggggttttattgtgttagttaggatggttttgattttttgattttgtgatttgtttgttttggttttttaaagtgttgggattataggtatgagttattgtgtttagttaagatattttgaagatgttgtaagttgtagatgtttgatatttttttgtggttgtttattattatattagtagttattattatttatttgttatatattttgaatttaggagtagttatattagaaatgttatatgtatgttgtgttttatttaagtttgattttgaaattgtgatagtaaagaatagttgttatgggaaagaatttattagtatttatttatataattagagaaagttgggatggaaaaggttttattataattttttattattgttttgtttttatgtagaattatatttgttatttaaatgggaggtggattattttttttagatgtttgttagaaaataaaattagtgtagttttttaaggttttgtaaataaattttttgtttaaataatttttaaatttttggtgtttatttttaaattaatttttgtgtaatttaagtttaagttttgtgattaggtattatttagttttttttagttttttttttagataaaataatgttttattttttttaaagtagtgaattaatatatgtaaagtgttttgtttagggtttggtatagaatttaaaaattaatgatagttattattattagtttttttttttattgttattttaaagttgataggtagtttttgttgttgttttggggaaaaagagatatagagaaggtaaagttattttttaaagttttttagatgatgtagattagaattttgatttaaaggatttagagttaggtatttttgattgagaatggtgaggaatatttttttgatgtagattattagtaggaaaatagttttttaagtttagtttttttttttatagtaaatgtgagggatatttttttgtaaattagttagggatttggggatggggggtgttggaggtgggattgaaataagtttttgagagaggagtttaaagaagaataggagtttaggggtgtataggggaattagatgtggttttttttttgttattttttttttttattagtattttttttagtttttttagtttggtaagaatatagtttagaatgttatttagaagttttgggatttagtggagtagggtgggtatattagtaggaatttggaaagatttatgttagtatttaatttgggttagaaaaatgttttttagtgtttttatgtagaagtttgttttatttatgggtttggggaagatgggggggtgtttatagtatttagtatgtggttagagtttatatatattgtgtgtttagttttttataggtatgttttatatttatttatttatagttgggatttggaattttagtaggtagtttgagggttttaggttgggaaagaatttattatggagtttgtagttttattttaagtagggttggaaatgatatttaagttgagttattttgttttttttttttattttattgttttgtttgtatatagataatatagatttagttttggtttaggttttgtttttaatttgtttatttagaggttatttaatttagtttttgggattagaaaggaaatatttaaaagtattttagaaattttattttattaggagtgttttttaaagatgagtattttttagtttttgttattttttttagtgtttaattttttttaggtttagattttttgtgttatgtttgtaatataagttaatttgttgtaattttattttattttattttggttagtgtttaatagagattgaaaattattgaaaatgttaatttaaaaatattttttttattagtttttttaagttttttatgttgttttttttggaattgttttttttatatttataattttttttaaggggagtttttatggttatatttaagaatagagttagaaaagtattttttgtttttattttttgtgtttggttttagattgatgtattttttgattattgttgtaagttgatggatgtttttggtataatagtaagttttagttttgggtttatttaagtattatagttgttagggatgtgtttatggataattttatttttaagatttaatgggtaattttatttaaattttttttgtagagaatgataataggagtaagttttttgaaagttttatttattatggtaaagatagttttatgaggtttttttagtttttaatggtgatttttgttattttttttgaagttttagttgagtttttggtttttttttttaagttattgatttagtagattggagatagagtggttgatttgttaaagaggataattagagggataatagggttaatagtaatagaaagatttatgttaatattatttaagtagaattattgtttttattagaattttgtggtttaggggaaaattttaggagatttttttttaggtttaaaaaagggagtagattgtaattatattaaatgtaggaggtagggaaattatttatttgatttttgaggtttttagtagttttagtgttttatgagtttttagttttttttaaatttagagttttgtttattgttttggtagtatttagaatggagatgtgtaatttatttaaagttttggtatataaagatatttgttttttggtttaggttttttttttttaattttttgttattttttttatttgtaaagtattaagtttttttatttttttagtttttttttttatagtaatttagtaaagttttttttttttaaaaataattaagtattttaaggtgtttatggttggtttttggttattttttgttttttattgttgtttatagttgtttatttgtttttttattttgttaaaaaaaaaaaaatgttttagagggaaggatgtttaagaatatttttgggtttgtagagtaaagtttaggttggtggttaggaggtgagttgtagatgtaggtatagtttttattttgtttttagttttgtttttagtggtgttagtaagtatgattttaattttggaaaatatttgttttttatttttaatttttatttttttatttaagttgttttataaaggttaattttattgtggttttaggtttgtaatttgggtttttttttttgatttgtgttttttttgtttttatagagttttttattagtagtttttgtattgtggtggatgttgtgaatttttttaagttgtaggtgttgtgtttggatgggaatgagattaagtgtagtgttatgtttgttgatgtgtttttttgtttgtgttttgttagttttattgagatttgagtagttttggtattgggtattgggtggagagtttttgtggtatttggtttgatggtttggtttggtttttgttggaaggtttaggatggattatgtgatagaagtttatgggtattttttgtagtttttttttttgtaggtggggttagggggggtgattagggataggtagttttttgttgaggatataggtagaagtttatttttttttagggatagaagtggtggtagatggaaggatttttggatgttttaattttataaattttatggtttttaagttttttttaatgatttgaggttatggaattttaaaagtggtatgggtaatagtatataattatatttttttaataatttttggttgtttgtgagtagtatttgatagttttttttttgtgttgggttggttgtgtagttattttgggtttttatttgttgttttttaaaatatattttttgtttagttgttttttttgaaatttattttatttattttatttttttttatagatgttttttttgtgttttaagtagagttaggagattttaaggtatgtgagtatttgtttagtaatttgtggagataatttatattgtgtttgagggtgaaaggatattaggagttatttttatatttttttaattttatttttggaaagttattagattggaggttattagtatgatgataatatttatgatttgatgtgggaggagatagttaattttaggtttagattaatgtatagggttatattttggtagttgggtagttttttgaaggtggataagattttagaagaggaaaggttagattttgtttattattagtatttgtaatgggttaaatatattttaaattggttgagttgagaaagtagttttagtagttttatttttgtttagtattttttgtattttaaatagtattttatttgggtttttatttataaaggtagtggttatatggtttttaaagtatgagaaatatagtttgttttttttttttatttaagtaggaagattttatattttgatggtagagatagattttaggtagttttggatttgttagtttaaagaaggaggatgtggttaatttgttttatttggtttgttttaaggttatagttaaaaagtattagttttggttggggtttgtgaagtttaggttaggtagttaaattttgtttgtgttgggtatataattttttgtttttatatttttgagttatatttttattagtgaaggtggtttttgttttatagtttggttggggagtatttaattttttttattttaaaaggtaatgttgtttggggtttaatttatttgttttttgggtaaggttgggataaagttatttgggtagttaggggtaaggattgttggaggagagttagtttaagtataggttttgtttagatgttattatatttttgatattgtgtatgttttgaagtattttttttgagaagggaagaggggatttttggattatgtttttggttttagatttggaatttataaaagttaaattagtttattttaataaaggagttttgatgtgaggggtaaggttgttttttgttttagggttttttagaaagtatttgtatgtgaatattattatgtttttataaaggatttttattataggaaaagtatgagtggtggttaatttgattaataaagttattttatgattgtatttataagagtggagttatttaaagtagattgtaggagggttattttaggaggatttggtgaggttgtaggttatataggttttggattgatgagtttttttttttatttattttgtttgggtagatgaagttaagaggaaaaaaaaatgaaaaaaaaaagttatttgtataaaagttgtagttagtaaattgtgtttt

SEQ ID NO: 74 - DNA, 14552 bp, Homo sapiens
taacggttaggaagggtttaaattatttttagggttaatttaaggtcgttttttgggtttgtatatttttgtgttgagtgcggatcgggagaggttgttgaagataggaggggataaatgggggacgaaggggttcgagggaggggattgaaggatttgggttaagtcgggagttttcgagggcggagttaaaacgtatttggattttgttagttttaaattttgtttttattgttgtaagttttttagatcgaggattttcgggttgagggtggggtaaggataggtagtgttttttttcgttttattttcgtttgtttttttttcggtggttttttttcggcgtttcgattttaggcggttttttcgttgttgttagtcgatttttttttatttttatttattatttcggtcgttagacgttgtttatagtttcggttttgttttttacggttgtgggttcggattttacgggatttttatgggatttttataggatttttacggtttgagtttaaggttcgttttttcggggaggcggatgtgggaggttcggttcgggtgcgggttagcgattcgggagttgcgggcggttgggaggggaggtcgttttgaggggttgggagcggcgcgggggtgggtttcggttttgtagttttagcgaggggcgagcggcggttagtcggcgagttgggtaataaggaaacggtttattaggagggagtggtggagttgggttaggtaggaagacgttggaataagaaatatttttgttttagtttttattttagtttcgggaggttgtcgcgttagttgcgtcgagcgagttttttttcggttttagttcggttcggggtcgcgttcggattttagttcgtcgtttagcgttggcggtgtaattgcggtcgcgcggtggaggggaggtggtttcggttcgtcgaaggttagcgtttcgttattcgtagagcgggtttagaggtgagtcgaggttcgcggacgggatcgggtggcgggcggtttgattttcgttttagtgggtttttttttcgggcggattttagagttatcgtagagtggtcgcgggaggtttagttttagtttattagaaaggtaagttgtttttggttgattacgtatagtttttatgattttatttgagatttggaggggaatggacgagattggattggaaattagaaatttggttttagtcgggtgatttggggttagtgattttatttttttgtttttttattttttttataaaatgggtagtgggatttttgttttgttttatttatatagaagggattatacgttttttaggtcgttgggtggatttggagtgaatgtttatttttatagttgttgagttttttagtagagtttattttttttagattagtttttttagttgttgtttgaggaatttgatattattattttaatttaggagttttattttaggcgcgtatggttagttatttttttgttacgatttttttttaggatttaggttaaaggggattttagtttttttttaggttgggattttagatttttttatggaggttagtgttgtgaaatttatggttgggttggttgttttagtttttttttttttttttaaggataggggtataatggatagttgtttttattttttttatgtatggttagtttttggttgagttagggtttgttttaatatttgtttttttatttgtttttttattttattggtttgttagaaatagttattattgattgagtattaattatgtagatatttagatatatatatttttttttatgtaattttggtcgtaatttagtggaagaggggttattattttttttttatagaaaaggaaatagatatgaatatgggatttgtttaaaattttttggatggtggggtgaatggtatggttggggttttgataatattttagtgtttattgtgtattatttatattttgttaaataattgtattatattttatttatgagataatattattattatttttattttatatatgatgggaagtttaagttttagaaagtttaagtaacgttttaaattttatatttttaagtggtaaaggtaggatttgaatttaggtttttatgttttagagtttatattttaatttttgtgttatattgtgttgtttttatggtttgtttgagatttgaaaatttaggtattatttggatgttttattgtattatttcgttgtgaagggttaataaattatatggatgaatcgtaagggtaatttaatatgaatagttgggtttgtttttttgttgttggggtaaggtttattgaagtgtagagtgagtttagaaggttgtgtttgatatggcgtttttttagttttgtgaagattattgttgtgttgagttattgtcgttgatgggagtaggttttattaattttttaggtgtgttagggagaaaaatattgataagtatttttcgggtatattattattttggttttttttatttgaggtttagattttgattaagtttatggtaaatagatgatttttgggtagtaatattatttttgttgtttgggttaatatagtgagattttatttttattaaaaataaaattgggtatggtgttgtatttttgtagttttttgggatttgggaggttgaggtgggaggattatttgagtttaggagtttaaggttatagtgagttatgattgtattattgtattttagtttgggcgattgagtaagattttgttttaaaaaaaattaaaaataaataaaaacgttgtttttatttaaataaatttgagtagggtattcgttaataataatagtagtgggtaatttgtatacgtttatcgagatttatgtttttttttttttttgagggatttatttaattttaaataattggaggaataataatgattaaggaatgatttattattagtaatttaagtttattaagatacgtttagtgattatggataagaaattgaatatttttgagttttattttttttcgttggattgttgtgatgattaaattagataaattatttaagtttagtatttagtatataattagtatttagagaaggttaattgttattattaagtattttatagtgtttagttaacgtttgaaattagtttaacgtttgtaatttttggttaataatagtgatgtttttgttagtaggagattttttataaagttttgtttagaagtgaaaggattttgttaggttttaggagtttgtttgtgttatagttagattttagggtaaatcgtatagagttagttttgagtttggattggtcgggatttagtatttttttgtatttgattttatattgggtttagttaaaaattggatagttttaattttattttattatatttttaggattagattatagatgggttttgtagatgtagatagtttcgttttatagtgttattacgttttagttttggtgtttatttttggttgttttttttgtagtagatggggagtattttgggtgggagtgagtgttttttttttttgtattttatttttatttatttagtagggttttgtatagtaaaatgaaagtagaggaattagatttagcgttgtgtttatataaattgattagaattttttggggaatttttaaaaaatgtatgttttttgttgattttaggattgaattagagtttggagtgagggtgaaattagtgaatatgttttttttagtgagtattttaggtgattttgatgcgtgataaagtagaaggagggtggattggggtacggttagagaagtagaggtacggatagaggattttagaggaatgtcggattttagttttattgttagttatttttttttttttattttaaatttttttttttgtagttttttgggttagtaaaggttgttaaggatggttttttgttagtattttagtgggtagatttagtttttttagggtgttttttttattttattttatcgttagttttgtcgtatagtgttagttagagtttttattggttgcgggaggggtaagaggtaggaggttaggtagaggttggggatatagttgtagtagtttagggttttgtttttttttttagtttgggtttttggggtagaggaagtttaggtaggaaggttaggtttgttattagttagagaggtttatgaagtttttttattttatttttagttatattgtttttagagttttagtattttgggtttttatttggtattatttttagattatgggttttttgaagtttttgtggttatgtgtttagttttgttaggtttattatgttatgttaaaggatagtttttttgttttgtgttttgtttgaggatttagtttttagatatatatttgtatatgttttattatttagaaagttttgttgttgtttgattagggttttttttgttgtagttttagttaatattttttggttttaaatttgtgagaaatgaagattgggtggttttagaagtattagttggtgtgggatttggattggggattattatagattagaattattttttttaatattttttaataaatttttggaaaagtttaattttagttagttatggaaggttaaatatttagtgtttaagtgtgttttattttttttgttatattattggttttttatttatttttttttagatggtaaggggaaagaagggggttagggaatagtttcgagagggtagtttatattttggtgagtttgtagagaggtttttttatatttggtatgattttgtttcgttcgagttttgtatggttgttatagttttgagggtttagatatgggttgttattattggatagggatagagcgaagagagtatttgattaggagtttggaaatttgggatgtacgtttgttggtgttagtgagttttgtttgattcgggataagtttttttttttgtatgagttttattttttttttttgtaaaataaggagttggattttgtgatttataggatgtttatttagaattttgttatgtgggtgttttaggtataaggaattaagggtagtaaggaattaagggtatatttaaaaagtttttttagattttgtggttgttgtagtttattttgaaaatatgtttttagttttttgttgtgcgtgatttttgtttgttttatttagattttaatttaaataattttgatttttgtttttggtttggtaggattttgaatggtaggaagcgaagataggagtttgtttatgtttgaggtagttagggttgggggggtattgagaaagggtaggtaggggtggaagttgtgagggagtgggaaagagatatagaatagaaggggagttgttggagagatgttttttttattttaattgggtgttttttgcggtttttttaatttgtttgtagtttgagtttagtagtaggagtgtagagttagggtttttttaagtttttagttatttaaatattgttttttattttttatttttaataggatggtttttatggggaagtgaattaggattttttttgtaggtttcgttttaaagttaggcggtagggagtagggaggcggtttttttgttttttttttaaaaaaaattttgtgattttttttgggtaggagggagttacggttagcggttgttatattttatggtttttattttattttttttgtttttttttgtagggattatgattttgggtttttttaggaaaggttttttgatgttgttgatggttttggtgatttagggtgagtattgggggagtagttaggaaataggaatttggatatagaaagggttatttgggtttagattagttttgtttggggttgaatttgagaagttggggagaatgtaggagtttgattggagagtggaggatagtgaggttttattagatttagtttttagttattttagtttttttttgttttttttttgatttagatttgtaggttggagttttgttagattagggtggaagtttatatgtggggtggagggagagtaggtgttggtaggttaagtttgggagagtatttagggttggggttgggggtttagtttagtttagaattgggaggggaggatttaggagttaggaggggataaaagtttgttttttagagtgttagttgttttgaggggagggttttgagggaaggatgattgaggatgaaagtaagagattaaagttttaaggtgtttgtttgaggggttagacgagagggatagtaggatagaaatgggtgtcgggtttagtttgggggagttgggattatagtggttgagttttcggtgtgttttttaggagattttgtgaagtcgtttcggggttcgttggtgatttgtacgtgtgagagtttatattgtaaggggtttatttgtcggggggtttggtgtatagtagtgttggtgcgggaggaggggaggtatttttaggaatatcggggttgcgggaatttgtatagggagttttgtagggggcgttttatcgagttcgttaattattattgttgcgatagttatttttgtaattataacgtgtttttggtgttggagggtacgtttagttgttttagtattttttttttatttttttggtttttgttttttttttttttttttttttttatgttttggttaataaaggggttgggggcgggggagcgggtgggtaggattttgggatttaattggtagagtggtttggttcgaggtggggggagttgatttagtggaagttgagttttagtgttttttttttttagttatttaatttttttcggagtagtcgggaatagatggttagttggttttgattttgggtttcgtgttggttttgttggttttggtggttttgggtgttttgggtttgtggtatgttcgacggaggtaggagaagtagcgtggtttgtatagcgagttgggagagtttagttttattttgaaagtatttgagtagggcgatagtatgttgggggtatgggtttggggatttgggatatagggtgtaggaggggtagataggaattgtagaattagaggggttatttagagattagagtcggtggggagttgggcgagtgaggagtttgtagtgatttagtaggttttaggtcgaggatagagaagggggttgtggttggttgtggtagttttttagtggttttttcgtatttttaggattttttggatagtgattgtattatagggagtggtttagggtttttttttttggtgtagaggatagtggtacggtaggttgttttggtggagtgtgtgggtgagtagtgggtgagttcggtggatgaggattaagggtttttatgagtttggaggggtgagggagtttttggttattggaattataggcggtgttaggtttgggttagaattggaattttgttgggtagggagtgggttggagacgggttagggttaggtttttttttttgtaggatcggggtggaacgagaggtagttgggggtggtttgttattgggtttgggtttggattaagttaaatttaagggtttggggttttgtgggtggggtgggcgagggaggtagcgtagtattaagatggggggtttttttagggttttgtgtgtttagtgtgtaatttttatttttttttttggttattaggaaaaggtcgttatggcgaagtgtggcggggtttgtggtacggtgagagtgtggtcgttaagatttttttttcgagggatgaatagttttggtttcgggagattgagatttataatatagtgttgtttagatacgataatattttaggtaaggggagaggttagttgtgttaggtttggggttttgtttttttgtatttagggtttaagtttgtagatttttagatattaatagaattttgaaggatttttagtttatttgtagtattaatttttttttttaatttaatttaatttaatttaatttaatttaatttaatttaatttttgagatagggtttcgttttgttatttaggttgggatgtagtggtgtaattttattggagttttaattttttgagtttaagtgatttttttattttagttttttgagtagttgggattataggtatgtgttattatgtttagttaatttttttattttttgtagagacgaggtttttttatgttttttagattggttttaaatttttaggtttaagtagtgtttttgttttggttttttaaagtgttgggattataggtgtaagttattaagttaggtttagatttaatttttgattttagttttgtttttgatttaagttatattaatttttatttttagatttagtttagtagtgatttagtttatttttttttttttaattttattttgattttgacgattttagttttttttagttttagttttttggttgagttatttaatttttttgtatataggttttatcgttttagatatgatttttcgtaattcgagtacgtagttgtggtttattacgtattattacgagtacggttttttttacgattttttgtagagatagacgttggagttttatttggttttgaggttagttgtgttcgcggtatgcggtttggcgtatttgtacgtggagattttcggtatatagggtaaattagttattgtttatcgcgattttaagagtcgtaatgtgttggttaagagtaatttgtagtgttgtatcgtcgatttgggtgagtcgggcggggtaggggcgcgttttttataggtgggcggagtttgtgcgttttttttttttttgtttgtgggcggtgattatgattagtatttgaaaatttagaggtgtatgttgttttagttttttttcgtaagattttacgagttgtttgaatattttttttaaatttagattttttttattatattattttggttttaggagttgggagaaaggaggtaggagttaggaatttgggtttttattttggtttcgttagtttttaggtttgttttgtgaagtgggtttataatgtttgttttgtttatttatatttcgttgggtttttgggaatttagagagtattatataagtaaagagtatttggggttatggttttttttgtggttattgttttttagtttattttcgtgtacgtttttatttgtttttttttttttgttttattgttttttttagtttttattttgtttgttttttggattttaggtttgggagaggggtaggagtgataggttttatttttataggtttggttgtgatgtatttatagggtagcgattatttggatatcggtaataattcgagagtgggtattaagcggtatatggtattcgaggtgttggacgagtagattcgtacggattgttttgagttttataagtggattgatatttgggtttttggtttggtgttgtgggagattgttcgtcggattatcgtgaatggtgagggtttattttatatagggtagggaaaggggaattagtttgtggagttaggggtttttagttatggttagtgtttatggtttgggaggtttgtagttagattttttggtattttttttatgttgtttattagttggtttagttgagtgattttttaaggtataaattttaaaaatagataatagggtttgtgagtttggttgtgaaattttgggtatatgataataatagaaatattaatagtagttaatattgattgagtttaaatatgtgttagatgttatgttatgtattttatatgtattatttaattttttggtatggataaggtagtggtattgtttagtggttaagagtataggtttggaattagattttttgggttttatttttgattttgttatgatcgtgcgtaggttatttgatttttttgtgttttagtttttttatttgtaaaatgggtgcgatggtttatgtttgtaattttagtattttgggaggtcgaggtaggtagattatttgaggttaggaatttaagattagtttggttaatatggcgaaattttgtttgtattaaaaatataaaaattagttggttgtggtggtatatatttgtaattttagttattcgggaggttgaggtaggagaattatttgaatttaggaggtagaggttgcggtgagttaagattatgttattgtattttagtttgggcgatagagtgagattttgttttaaaaaaagaaaatttattaaaataaataaataaaatgagaataaaaatagtttttagttgttgagataatttaagtatttagaatagtatttagagttaaatattagtggttgttattgttgtagatagaatgagtgtttgatattatattgtttttattttatagttgaggagacgggggtatagaatgatagtgggtttgaggtagtattagggttcgaaatcgggtagtttgtttcggggttagtgtttattattattgtgtgtatttaaatttttttggtttttgatttttttatgtacgtaatgtatgtgagtgtttgtattgtttgtttattgttgtttggttgttattgtgggttgttataggggattttgatttagagggattgcgataggtagagagatttgttttgggtaggtagttttgaggtcgatgtttttttagttttggagtggacggaggataggtgggtcgtttagattggtgggagtattgttaatttttgaggaggttgtttatggtgagggatttttaggagtcgtgataggttggggataatttttaggatatggttggagttttgttttttggggataaggatgtttttattttttgagtatttattaggagttagttttatgttagattttatttgttttcggtggttattaattgaaaatagaggttgtggtgttatcggttttttggggagatttacgaggtgtttagattttttaagatttcgggtatgaattgttagagtgggttttaaggagatcgggatcgggggaaagaggaatttggaagaagttaaggttttttggattaggttgtagggtagaaaggaaaggttgggaggaggttgtttggggtggagggggaagttttattagttttatacggattcgcggcgtattataaatattgtaatttggtgttagtttcggtattgattaaaggtttattagatatatttaggtttttgtgtagtattgattagggcgtgagcggtataggggtcggtttggaagttggttatggggagaatagttggcgaaggttttatcgaggttgcggtttgtgtggttatggtttttagttttaggttgggaaataggatggggtacggggttgtttgcggttttatcggtattgtttttagaaagtttttattaaaaattgtgaatttgggatattaagaggagggggttagtgttggttgtaggagttagtagaggtttgtgttatttttgatattgggtgatgttatgtggatttgggtaaaaagataagtgtagtttagaggttaagagtatatgttttggtgttagattgtgggtttaaattttagttttgttatttattatttgttgattttagataagttttttaaattttttggtttttattttttggtttataaagtggagtttatagtattatttattttatagggttgttgtgaggattttatgtagagtttttaggatagtatttggtatatagtgtttagtaaatatttggtgttattattattaggtatgtgtgatagttggggtttgggagtagtttcgggtattgggtggaaggtagttgagggaagattggaataaggttggtttaggaattcgagatgggtttgagttttgtttttgttattattagttgtggaattttgggttttttttttttgagtattagtttttttatttgtaaaatggaggtaatattagtatttattttatagggttgttgtgaggataaataggataaagtatgtaaagtgtttatagtagaatatttggtatatgttatgtgtaaaataaatggtagttattaatattagttagaaatatatttattgtattatattgttttttttaggggtagcgtgtttaggttattggtttttggtttttggatagagggtagaaaaggtttttttttgggtggtattgggtttttttagagttttaagtgattgttttgtttattttttatttttaggtatcgtggaggattatagattatttttttatgatgtggtgtttaatgattttagttttgaggatatgaagaaggtggtgtgtgtggattagtagatttttattatttttaatcggttggttgtagattcggtgaggtttttgttgggattaggatggcgtggggtggtggtttatggttgggatttttgggtttaggaatttgtgtttgaggtttttgttttattttatagatattgagtgttttggttagggtatttttttaggtatttttttttttaattttggtttatgttttttgtttttagggttatttggttattttgggattttaagaatttttattttttttgtgaaaagttagaggttatttgtggttttgtgtgtgtgtgtgtgtgtgtgtgtgtgtgtgtgtgtgtgtttgagagttagggttttgtttgtttttgttatttaggttggggtgtagtggtatagttatagtttattgtaattttaaatttttcggtttaattgattttattgttttagtttttttagtagttaggtgtagtgtatattattatatttggttaatttttaaaattttttgtagagataaggttttttatgttgtttaggtttattttaaatttttgggtttaagtgatttttttgttttagttttttaaagtgttgggattataggtgtgagtttttatatttgattattgtggtatttttgttgttatttgtttttgtttgttgttgttttgttgttgtttgtttttgtttttttttaaaatattttatttgtataaagatatatatacgtatattaatatatataagcgtgaatatttttttgaatatatatttatagaaatatatatatgcgtatatatgttagattgttggtttcgtgaggataaagaacgtgttttttgtttatttttatgtttttattatttattatagtatttggtttataataggtgttaataaatatttattgaaagaatgaatatattttatatatgtatatatttatgtgtatatagatatatatttttgtataatatattcgtaaaaagttatatgtatgtatttttgtatatatatatatatatttatttttaggagttagaagtggggttagtttattttaggttttgggatgggttgatgagttttttgggatgggttgatgagttttttgggatgggttgttttttggatatttgtatttttagggtagtttttatttttatagttttttgggtttagttatggttgatggaggggttggaagatattgttttttgtattggggttttaggttgtggatggggatgtgggagtttttaggtttgaagaatcggtttttttttatggattttggtaaaggtggggatgggggtaaggtgttttatagatattgtttgtttaagggggtttgagtgtttttgaagatttgagttttttttttttgttcgttttgtttttttttattttttttttattttatttttttttttttttattttttatttttttgttattttttgtttttttttttattatttgttttttttttcgtttttttttttaatgtttttatttttttttttttatttttttttttttgtttatgtttttttattatcggttattttttttattttttttttattttttttgatttatttttttttgtatttttttttcgattttttttttttttttgtatttttttttttgtttttttttttttgtattttttttttaatttttaggtttttttaggtttagtttagatgatgcgggagtgttggtatttaaatttttttgttcgatttatcgcgttgcggattaagaagatattataaaaaattagtaatagtttagagaagtttaaagtgatttaatagtttaggagtatttgatttttttttgtttgtagggggttgggggggtggggggtagtggatggtgttttatttgggtagaggtagtgtgagtgtggtgtgtgttggggatgggtagttgcgtttgtttgttcggtttttagtttatttagttaaaaatatagttgggttgaaatttgattttttgttgtttggtttgtttaaagcggtaggttttttgacgtttggttttttttttatttttatggttagtatggtgtattttttattattttcgggataggatgtaaaagaggttttagagttagagtgttaagttagggaattttagttttagatttagagttcgggtttgtattttgttttttgtttttgatta

SEQ ID NO: 75 - DNA, 14552 bp, Homo sapiens
taatggttaggaagggtttaaattatttttagggttaatttaaggttgttttttgggtttgtatatttttgtgttgagtgtggattgggagaggttgttgaagataggaggggataaatgggggatgaaggggtttgagggaggggattgaaggatttgggttaagttgggagtttttgagggtggagttaaaatgtatttggattttgttagttttaaattttgtttttattgttgtaagttttttagattgaggatttttgggttgagggtggggtaaggataggtagtgtttttttttgttttatttttgtttgttttttttttggtggtttttttttggtgttttgattttaggtggtttttttgttgttgttagttgatttttttttatttttatttattattttggttgttagatgttgtttatagttttggttttgttttttatggttgtgggtttggattttatgggatttttatgggatttttataggatttttatggtttgagtttaaggtttgtttttttggggaggtggatgtgggaggtttggtttgggtgtgggttagtgatttgggagttgtgggtggttgggaggggaggttgttttgaggggttgggagtggtgtgggggtgggttttggttttgtagttttagtgaggggtgagtggtggttagttggtgagttgggtaataaggaaatggtttattaggagggagtggtggagttgggttaggtaggaagatgttggaataagaaatatttttgttttagtttttattttagttttgggaggttgttgtgttagttgtgttgagtgagtttttttttggttttagtttggtttggggttgtgtttggattttagtttgttgtttagtgttggtggtgtaattgtggttgtgtggtggaggggaggtggttttggtttgttgaaggttagtgttttgttatttgtagagtgggtttagaggtgagttgaggtttgtggatgggattgggtggtgggtggtttgatttttgttttagtgggttttttttttgggtggattttagagttattgtagagtggttgtgggaggtttagttttagtttattagaaaggtaagttgtttttggttgattatgtatagtttttatgattttatttgagatttggaggggaatggatgagattggattggaaattagaaatttggttttagttgggtgatttggggttagtgattttatttttttgtttttttattttttttataaaatgggtagtgggatttttgttttgttttatttatatagaagggattatatgttttttaggttgttgggtggatttggagtgaatgtttatttttatagttgttgagttttttagtagagtttattttttttagattagtttttttagttgttgtttgaggaatttgatattattattttaatttaggagttttattttaggtgtgtatggttagttatttttttgttatgatttttttttaggatttaggttaaaggggattttagtttttttttaggttgggattttagatttttttatggaggttagtgttgtgaaatttatggttgggttggttgttttagtttttttttttttttttaaggataggggtataatggatagttgtttttattttttttatgtatggttagtttttggttgagttagggtttgttttaatatttgtttttttatttgtttttttattttattggtttgttagaaatagttattattgattgagtattaattatgtagatatttagatatatatatttttttttatgtaattttggttgtaatttagtggaagaggggttattattttttttttatagaaaaggaaatagatatgaatatgggatttgtttaaaattttttggatggtggggtgaatggtatggttggggttttgataatattttagtgtttattgtgtattatttatattttgttaaataattgtattatattttatttatgagataatattattattatttttattttatatatgatgggaagtttaagttttagaaagtttaagtaatgttttaaattttatatttttaagtggtaaaggtaggatttgaatttaggtttttatgttttagagtttatattttaatttttgtgttatattgtgttgtttttatggtttgtttgagatttgaaaatttaggtattatttggatgttttattgtattattttgttgtgaagggttaataaattatatggatgaattgtaagggtaatttaatatgaatagttgggtttgtttttttgttgttggggtaaggtttattgaagtgtagagtgagtttagaaggttgtgtttgatatggtgtttttttagttttgtgaagattattgttgtgttgagttattgttgttgatgggagtaggttttattaattttttaggtgtgttagggagaaaaatattgataagtattttttgggtatattattattttggttttttttatttgaggtttagattttgattaagtttatggtaaatagatgatttttgggtagtaatattatttttgttgtttgggttaatatagtgagattttatttttattaaaaataaaattgggtatggtgttgtatttttgtagttttttgggatttgggaggttgaggtgggaggattatttgagtttaggagtttaaggttatagtgagttatgattgtattattgtattttagtttgggtgattgagtaagattttgttttaaaaaaaattaaaaataaataaaaatgttgtttttatttaaataaatttgagtagggtatttgttaataataatagtagtgggtaatttgtatatgtttattgagatttatgtttttttttttttttgagggatttatttaattttaaataattggaggaataataatgattaaggaatgatttattattagtaatttaagtttattaagatatgtttagtgattatggataagaaattgaatatttttgagttttatttttttttgttggattgttgtgatgattaaattagataaattatttaagtttagtatttagtatataattagtatttagagaaggttaattgttattattaagtattttatagtgtttagttaatgtttgaaattagtttaatgtttgtaatttttggttaataatagtgatgtttttgttagtaggagattttttataaagttttgtttagaagtgaaaggattttgttaggttttaggagtttgtttgtgttatagttagattttagggtaaattgtatagagttagttttgagtttggattggttgggatttagtatttttttgtatttgattttatattgggtttagttaaaaattggatagttttaattttattttattatatttttaggattagattatagatgggttttgtagatgtagatagttttgttttatagtgttattatgttttagttttggtgtttatttttggttgttttttttgtagtagatggggagtattttgggtgggagtgagtgttttttttttttgtattttatttttatttatttagtagggttttgtatagtaaaatgaaagtagaggaattagatttagtgttgtgtttatataaattgattagaattttttggggaatttttaaaaaatgtatgttttttgttgattttaggattgaattagagtttggagtgagggtgaaattagtgaatatgttttttttagtgagtattttaggtgattttgatgtgtgataaagtagaaggagggtggattggggtatggttagagaagtagaggtatggatagaggattttagaggaatgttggattttagttttattgttagttatttttttttttttattttaaatttttttttttgtagttttttgggttagtaaaggttgttaaggatggttttttgttagtattttagtgggtagatttagtttttttagggtgttttttttattttattttattgttagttttgttgtatagtgttagttagagtttttattggttgtgggaggggtaagaggtaggaggttaggtagaggttggggatatagttgtagtagtttagggttttgtttttttttttagtttgggtttttggggtagaggaagtttaggtaggaaggttaggtttgttattagttagagaggtttatgaagtttttttattttatttttagttatattgtttttagagttttagtattttgggtttttatttggtattatttttagattatgggttttttgaagtttttgtggttatgtgtttagttttgttaggtttattatgttatgttaaaggatagtttttttgttttgtgttttgtttgaggatttagtttttagatatatatttgtatatgttttattatttagaaagttttgttgttgtttgattagggttttttttgttgtagttttagttaatattttttggttttaaatttgtgagaaatgaagattgggtggttttagaagtattagttggtgtgggatttggattggggattattatagattagaattattttttttaatattttttaataaatttttggaaaagtttaattttagttagttatggaaggttaaatatttagtgtttaagtgtgttttattttttttgttatattattggttttttatttatttttttttagatggtaaggggaaagaagggggttagggaatagttttgagagggtagtttatattttggtgagtttgtagagaggtttttttatatttggtatgattttgttttgtttgagttttgtatggttgttatagttttgagggtttagatatgggttgttattattggatagggatagagtgaagagagtatttgattaggagtttggaaatttgggatgtatgtttgttggtgttagtgagttttgtttgatttgggataagtttttttttttgtatgagttttattttttttttttgtaaaataaggagttggattttgtgatttataggatgtttatttagaattttgttatgtgggtgttttaggtataaggaattaagggtagtaaggaattaagggtatatttaaaaagtttttttagattttgtggttgttgtagtttattttgaaaatatgtttttagttttttgttgtgtgtgatttttgtttgttttatttagattttaatttaaataattttgatttttgtttttggtttggtaggattttgaatggtaggaagtgaagataggagtttgtttatgtttgaggtagttagggttgggggggtattgagaaagggtaggtaggggtggaagttgtgagggagtgggaaagagatatagaatagaaggggagttgttggagagatgttttttttattttaattgggtgttttttgtggtttttttaatttgtttgtagtttgagtttagtagtaggagtgtagagttagggtttttttaagtttttagttatttaaatattgttttttattttttatttttaataggatggtttttatggggaagtgaattaggattttttttgtaggttttgttttaaagttaggtggtagggagtagggaggtggtttttttgttttttttttaaaaaaaattttgtgattttttttgggtaggagggagttatggttagtggttgttatattttatggtttttattttattttttttgtttttttttgtagggattatgattttgggtttttttaggaaaggttttttgatgttgttgatggttttggtgatttagggtgagtattgggggagtagttaggaaataggaatttggatatagaaagggttatttgggtttagattagttttgtttggggttgaatttgagaagttggggagaatgtaggagtttgattggagagtggaggatagtgaggttttattagatttagtttttagttattttagtttttttttgttttttttttgatttagatttgtaggttggagttttgttagattagggtggaagtttatatgtggggtggagggagagtaggtgttggtaggttaagtttgggagagtatttagggttggggttgggggtttagtttagtttagaattgggaggggaggatttaggagttaggaggggataaaagtttgttttttagagtgttagttgttttgaggggagggttttgagggaaggatgattgaggatgaaagtaagagattaaagttttaaggtgtttgtttgaggggttagatgagagggatagtaggatagaaatgggtgttgggtttagtttgggggagttgggattatagtggttgagtttttggtgtgttttttaggagattttgtgaagttgttttggggtttgttggtgatttgtatgtgtgagagtttatattgtaaggggtttatttgttggggggtttggtgtatagtagtgttggtgtgggaggaggggaggtatttttaggaatattggggttgtgggaatttgtatagggagttttgtagggggtgttttattgagtttgttaattattattgttgtgatagttatttttgtaattataatgtgtttttggtgttggagggtatgtttagttgttttagtattttttttttatttttttggtttttgttttttttttttttttttttttttatgttttggttaataaaggggttgggggtgggggagtgggtgggtaggattttgggatttaattggtagagtggtttggtttgaggtggggggagttgatttagtggaagttgagttttagtgttttttttttttagttatttaattttttttggagtagttgggaatagatggttagttggttttgattttgggttttgtgttggttttgttggttttggtggttttgggtgttttgggtttgtggtatgtttgatggaggtaggagaagtagtgtggtttgtatagtgagttgggagagtttagttttattttgaaagtatttgagtagggtgatagtatgttgggggtatgggtttggggatttgggatatagggtgtaggaggggtagataggaattgtagaattagaggggttatttagagattagagttggtggggagttgggtgagtgaggagtttgtagtgatttagtaggttttaggttgaggatagagaagggggttgtggttggttgtggtagttttttagtggtttttttgtatttttaggattttttggatagtgattgtattatagggagtggtttagggtttttttttttggtgtagaggatagtggtatggtaggttgttttggtggagtgtgtgggtgagtagtgggtgagtttggtggatgaggattaagggtttttatgagtttggaggggtgagggagtttttggttattggaattataggtggtgttaggtttgggttagaattggaattttgttgggtagggagtgggttggagatgggttagggttaggtttttttttttgtaggattggggtggaatgagaggtagttgggggtggtttgttattgggtttgggtttggattaagttaaatttaagggtttggggttttgtgggtggggtgggtgagggaggtagtgtagtattaagatggggggtttttttagggttttgtgtgtttagtgtgtaatttttatttttttttttggttattaggaaaaggttgttatggtgaagtgtggtggggtttgtggtatggtgagagtgtggttgttaagattttttttttgagggatgaatagttttggttttgggagattgagatttataatatagtgttgtttagatatgataatattttaggtaaggggagaggttagttgtgttaggtttggggttttgtttttttgtatttagggtttaagtttgtagatttttagatattaatagaattttgaaggatttttagtttatttgtagtattaatttttttttttaatttaatttaatttaatttaatttaatttaatttaatttaatttttgagatagggttttgttttgttatttaggttgggatgtagtggtgtaattttattggagttttaattttttgagtttaagtgatttttttattttagttttttgagtagttgggattataggtatgtgttattatgtttagttaatttttttattttttgtagagatgaggtttttttatgttttttagattggttttaaatttttaggtttaagtagtgtttttgttttggttttttaaagtgttgggattataggtgtaagttattaagttaggtttagatttaatttttgattttagttttgtttttgatttaagttatattaatttttatttttagatttagtttagtagtgatttagtttatttttttttttttaattttattttgattttgatgattttagttttttttagttttagttttttggttgagttatttaatttttttgtatataggttttattgttttagatatgattttttgtaatttgagtatgtagttgtggtttattatgtattattatgagtatggttttttttatgattttttgtagagatagatgttggagttttatttggttttgaggttagttgtgtttgtggtatgtggtttggtgtatttgtatgtggagatttttggtatatagggtaaattagttattgtttattgtgattttaagagttgtaatgtgttggttaagagtaatttgtagtgttgtattgttgatttgggtgagttgggtggggtaggggtgtgttttttataggtgggtggagtttgtgtgttttttttttttttgtttgtgggtggtgattatgattagtatttgaaaatttagaggtgtatgttgttttagtttttttttgtaagattttatgagttgtttgaatattttttttaaatttagattttttttattatattattttggttttaggagttgggagaaaggaggtaggagttaggaatttgggtttttattttggttttgttagtttttaggtttgttttgtgaagtgggtttataatgtttgttttgtttatttatattttgttgggtttttgggaatttagagagtattatataagtaaagagtatttggggttatggttttttttgtggttattgttttttagtttatttttgtgtatgtttttatttgtttttttttttttgttttattgttttttttagtttttattttgtttgttttttggattttaggtttgggagaggggtaggagtgataggttttatttttataggtttggttgtgatgtatttatagggtagtgattatttggatattggtaataatttgagagtgggtattaagtggtatatggtatttgaggtgttggatgagtagatttgtatggattgttttgagttttataagtggattgatatttgggtttttggtttggtgttgtgggagattgtttgttggattattgtgaatggtgagggtttattttatatagggtagggaaaggggaattagtttgtggagttaggggtttttagttatggttagtgtttatggtttgggaggtttgtagttagattttttggtattttttttatgttgtttattagttggtttagttgagtgattttttaaggtataaattttaaaaatagataatagggtttgtgagtttggttgtgaaattttgggtatatgataataatagaaatattaatagtagttaatattgattgagtttaaatatgtgttagatgttatgttatgtattttatatgtattatttaattttttggtatggataaggtagtggtattgtttagtggttaagagtataggtttggaattagattttttgggttttatttttgattttgttatgattgtgtgtaggttatttgatttttttgtgttttagtttttttatttgtaaaatgggtgtgatggtttatgtttgtaattttagtattttgggaggttgaggtaggtagattatttgaggttaggaatttaagattagtttggttaatatggtgaaattttgtttgtattaaaaatataaaaattagttggttgtggtggtatatatttgtaattttagttatttgggaggttgaggtaggagaattatttgaatttaggaggtagaggttgtggtgagttaagattatgttattgtattttagtttgggtgatagagtgagattttgttttaaaaaaagaaaatttattaaaataaataaataaaatgagaataaaaatagtttttagttgttgagataatttaagtatttagaatagtatttagagttaaatattagtggttgttattgttgtagatagaatgagtgtttgatattatattgtttttattttatagttgaggagatgggggtatagaatgatagtgggtttgaggtagtattagggtttgaaattgggtagtttgttttggggttagtgtttattattattgtgtgtatttaaatttttttggtttttgatttttttatgtatgtaatgtatgtgagtgtttgtattgtttgtttattgttgtttggttgttattgtgggttgttataggggattttgatttagagggattgtgataggtagagagatttgttttgggtaggtagttttgaggttgatgtttttttagttttggagtggatggaggataggtgggttgtttagattggtgggagtattgttaatttttgaggaggttgtttatggtgagggatttttaggagttgtgataggttggggataatttttaggatatggttggagttttgttttttggggataaggatgtttttattttttgagtatttattaggagttagttttatgttagattttatttgtttttggtggttattaattgaaaatagaggttgtggtgttattggttttttggggagatttatgaggtgtttagattttttaagattttgggtatgaattgttagagtgggttttaaggagattgggattgggggaaagaggaatttggaagaagttaaggttttttggattaggttgtagggtagaaaggaaaggttgggaggaggttgtttggggtggagggggaagttttattagttttatatggatttgtggtgtattataaatattgtaatttggtgttagttttggtattgattaaaggtttattagatatatttaggtttttgtgtagtattgattagggtgtgagtggtataggggttggtttggaagttggttatggggagaatagttggtgaaggttttattgaggttgtggtttgtgtggttatggtttttagttttaggttgggaaataggatggggtatggggttgtttgtggttttattggtattgtttttagaaagtttttattaaaaattgtgaatttgggatattaagaggagggggttagtgttggttgtaggagttagtagaggtttgtgttatttttgatattgggtgatgttatgtggatttgggtaaaaagataagtgtagtttagaggttaagagtatatgttttggtgttagattgtgggtttaaattttagttttgttatttattatttgttgattttagataagttttttaaattttttggtttttattttttggtttataaagtggagtttatagtattatttattttatagggttgttgtgaggattttatgtagagtttttaggatagtatttggtatatagtgtttagtaaatatttggtgttattattattaggtatgtgtgatagttggggtttgggagtagttttgggtattgggtggaaggtagttgagggaagattggaataaggttggtttaggaatttgagatgggtttgagttttgtttttgttattattagttgtggaattttgggttttttttttttgagtattagtttttttatttgtaaaatggaggtaatattagtatttattttatagggttgttgtgaggataaataggataaagtatgtaaagtgtttatagtagaatatttggtatatgttatgtgtaaaataaatggtagttattaatattagttagaaatatatttattgtattatattgttttttttaggggtagtgtgtttaggttattggtttttggtttttggatagagggtagaaaaggtttttttttgggtggtattgggtttttttagagttttaagtgattgttttgtttattttttatttttaggtattgtggaggattatagattatttttttatgatgtggtgtttaatgattttagttttgaggatatgaagaaggtggtgtgtgtggattagtagatttttattatttttaattggttggttgtagatttggtgaggtttttgttgggattaggatggtgtggggtggtggtttatggttgggatttttgggtttaggaatttgtgtttgaggtttttgttttattttatagatattgagtgttttggttagggtatttttttaggtatttttttttttaattttggtttatgttttttgtttttagggttatttggttattttgggattttaagaatttttattttttttgtgaaaagttagaggttatttgtggttttgtgtgtgtgtgtgtgtgtgtgtgtgtgtgtgtgtgtgtgtttgagagttagggttttgtttgtttttgttatttaggttggggtgtagtggtatagttatagtttattgtaattttaaattttttggtttaattgattttattgttttagtttttttagtagttaggtgtagtgtatattattatatttggttaatttttaaaattttttgtagagataaggttttttatgttgtttaggtttattttaaatttttgggtttaagtgatttttttgttttagttttttaaagtgttgggattataggtgtgagtttttatatttgattattgtggtatttttgttgttatttgtttttgtttgttgttgttttgttgttgtttgtttttgtttttttttaaaatattttatttgtataaagatatatatatgtatattaatatatataagtgtgaatatttttttgaatatatatttatagaaatatatatatgtgtatatatgttagattgttggttttgtgaggataaagaatgtgttttttgtttatttttatgtttttattatttattatagtatttggtttataataggtgttaataaatatttattgaaagaatgaatatattttatatatgtatatatttatgtgtatatagatatatatttttgtataatatatttgtaaaaagttatatgtatgtatttttgtatatatatatatatatttatttttaggagttagaagtggggttagtttattttaggttttgggatgggttgatgagttttttgggatgggttgatgagttttttgggatgggttgttttttggatatttgtatttttagggtagtttttatttttatagttttttgggtttagttatggttgatggaggggttggaagatattgttttttgtattggggttttaggttgtggatggggatgtgggagtttttaggtttgaagaattggtttttttttatggattttggtaaaggtggggatgggggtaaggtgttttatagatattgtttgtttaagggggtttgagtgtttttgaagatttgagttttttttttttgtttgttttgtttttttttattttttttttattttatttttttttttttttattttttatttttttgttattttttgtttttttttttattatttgtttttttttttgtttttttttttaatgtttttatttttttttttttatttttttttttttgtttatgtttttttattattggttattttttttattttttttttattttttttgatttatttttttttgtattttttttttgattttttttttttttttgtatttttttttttgtttttttttttttgtattttttttttaatttttaggtttttttaggtttagtttagatgatgtgggagtgttggtatttaaatttttttgtttgatttattgtgttgtggattaagaagatattataaaaaattagtaatagtttagagaagtttaaagtgatttaatagtttaggagtatttgatttttttttgtttgtagggggttgggggggtggggggtagtggatggtgttttatttgggtagaggtagtgtgagtgtggtgtgtgttggggatgggtagttgtgtttgtttgtttggtttttagtttatttagttaaaaatatagttgggttgaaatttgattttttgttgtttggtttgtttaaagtggtaggttttttgatgtttggttttttttttatttttatggttagtatggtgtattttttattatttttgggataggatgtaaaagaggttttagagttagagtgttaagttagggaattttagttttagatttagagtttgggtttgtattttgttttttgtttttgatta

SEQ ID NO: 76 - DNA, 868 bp, Homo sapiens
gagaaatctaatatagatatatgaattctacgtagatacaaagacatcatgagaaaaactatgtttctgaattggtttgaacacaggaaatattttttgtgtacaggacaaagatgtctgaaagacagaaagatgcatataacagcctttccccagcatctctactgtgatccagtagaaaagcttatattcatgaccattctcaacagttacttttctcccacgcccccaagcagtgactctccaatctaaaataaagatacacaagaggttggtctcgttctagttttcctttcctgtcatcaaatgatgtcatctacattgagatgtcttggtttgtgtccttgtgactgaagatataagaaagcttgggaggccgaggcgggcggatcacgaggtcaggacatcaagaccatcctgactaacacggtgaaaccccgtctctactaaaaatacaaaaaattaaccaggcgtagtggcgggcgcctgtagtcccagctactcgggaggctgaggcaggagaatggcgtgaacccgggaggcggagcttgccgtgagccgagattgcgccactgcagtctagcctgggcgagagagggcgaccccgtcgcaaaaaaaaaaaaaaaaaagatgcaagaaacaagaaagcaagtttgccactgtccatgcttacaggattcatgtacacctgggaatatacatatgacatgagttgagtgaaaatttagtaacacaaattagaagaaagagaaagatgaaaattagtttaaaggaggtaatttacttaaggaggaaagttttgcattgaggcataaggaagtgacttccattaattggtgtgaaatggggagaattttatgtgcacagg

SEQ ID NO: 77 - DNA, 1079 bp, Homo sapiens
cggggagagcgaatgttttcgcagtgcatcatctcagcaggggtggagggagccgacgcgcctgcagagatgcccagtatgggcaaccaaggcggcagaaacaatccacaatcctgccctgtcctaagccgtcccttcccacctcccccaccccccgcccatcgcccaagttccatctctgccttaaaacacatgtgtctccctgtttcacagagggagggatgaaagacggctaggaacctttaggtacatttcacatctaaactttgtggatcccttatggaaggaatctgtgtgggtgcctgtggtgtacttttggtgacactcgtttacatctagtcggtgtggatggaaacttaagcaggcatgcagaatttaacatttcccatccgtttctgaaatgtctcccaaacgcttcgaaataagaaatgaagatctttaacttttctataattttattaccgatattttctggaacaatggaattttatgccaacaggttatgccatatttgcaaaatacacaaaatgtttataattgtagaattatttaaagcttcaagtttattaccagagaagatttttttttaatgtgcttggctgtgaggaaagatttgacttttctaattgactagacttaaaaaaaatgtgatagcgattaaagtattttgtctgttcctgaatctggggcttctgtctttactttattgtaaagaagcacaaaatgaattaaatagtaatcagtcattttactcttgagctgtaattaatcaggaaactcattatccaaaaatgaaaggacatgttacttatgcttccatatgcagtcaaaagtcaaagtatcacttgaaattattttaaaaaaaaagctggagtacacttgaaggggcacaggttaaaattaaaatggagaggggaatgtgggttgggagtaagagggaggagaaagggaaatggatggaatgctgaaagagttgattatttagttagagagaagacacaaaagtataaaagaactataaaggacaggctattgttggtagcaaaaatttttggaacaaaagatcagttttaactaag

SEQ ID NO: 78 - DNA, 741 bp, Homo sapiens
acaggcaaacaaggagatgcttccacagctccctgagctctgcccatcttccctagagctctagttctgcccaactctggcttcaaaaacatgacaactagttactgagggcccaaggataatgaccttatgtgtcttctccctgcaggtgcatcacctggatcatgaggtcacccctctgctggctcctcccacttctcatcttggcctcagtggcccaaggccagccaacaagacgaccaagacccgggactgggcccgggcgcagacccaggcccaggcccaggcccacacccagctttcctcagcctgatgaaccagcagagccaacagacctgcctcctcccctccctccaggccctccatctatcttccctgactgtccccgcgaatgctactgcccccctgatttcccatctgccctctactgtgatagccgcaacctgcgaaaggtccctgtcatcccgccccgcatccattacctctatctccagaacaacttcatcactgagctcccggtggagtccttccagaatgccacaggcctgcgatggattaacctggacaacaaccgaatccgcaagatagaccagagggtgctggagaaactgcccggcctggtgttcctctacatggagaagaaccagttggaagaggtcccctcggccctgccccggaacctggagcagctgaggctgagccagaaccacatctccagaatcccgcctggtgtcttcagca

SEQ ID NO: 79 - DNA, 731 bp, Homo sapiens
tttatgtaggtttcaatataatgaaacctacctcataggtttcattacatatgtaagtgatgtagttattaaactaaatgagatgacatatgtgaaaggccttggtaaagtactatacaaagtaacatgctagtattatttcagccagatttagacaatttttagtataagatgacctaaaagctagagagtggaaaaggattaccatattcccatccctagccgttcatataattattcttcatttgtgccgtgattcagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaat

SEQ ID NO: 80 - DNA, 840 bp, Homo sapiens
tttaaaggggcgcttgtgcggcgcctgccgagcgtgagagccgccccggcgtcggtctcccacttcagactcgacgcgccgaagctggccctgggtagacccgagctccttccccaccctcgggcgcgcccccacccctctcttccaaccccgcttgcgtttctgtcgccggcgccctcatcccctttttccaccgctgaaggctaagcagagaagtgggaagtgggggagagtggcccacaggaatggcaaacacacctggaaaccacaggccacaagcacagtcgcaccatcccccctccttcatcgccccgaaatatctccatccctcatccccaaccctagtggtcaggacccgcccctgaggggtctcagggtggcggctgagtggcgccgaggtgtacttggcagatgccacattcgggcggtggccccaggactgtgaggaggggtgcgggagggggtggggcaggtcgagggaccagccctggacggctctggctgccagaccctaagttctgtgggcagtcccgccccagcccgccagatttctgtgtgcccacttgccagccacgatgtccggattcctgtggaaaggggagggtgagcaggcagggtcacagctctggcctcagggtgagctccaagctgcctggcacaggatattgtctgtgatgaggggtggaaggagaaaccagaacccacattgaaccaaaccccagccgtgccagagccagagcagctgatatgggggaagcttggtgcagggaggaggatggatgagatctggtatccgttgattaaaggggacctaggatacggggtaactagcctctcttc

SEQ ID NO: 81 - DNA, 859 bp, Homo sapiens
gaggaattggggagaaaggggacccaattcctgtctttcacgagctcctggcccagtggcagagacagacaagcacatcaattactataaagcttgtagtaaatacattaagacaaaaataaggtaatgtgggaaaacagcagaggctgatccagctgcgggaaatcaggaaagaatccaaaaaagagggaatggagggtgggccacacagatcttgccttcaaggagtcagaggtggagcagagtgagtcctggaccgcctccccctctccccgtctccgtgcctcccaacgtctgcactgcaggaccccggccaggcctctggatgctctctggtctctgtctgcagaggctggctcctctgaggtatgcatgcgtcggcgtggagttactatttaaagttctgaccagaaaggaacacagctctcttcctgccacctgggaatcccctgcaacctgatcacgcccctgggcagagacttaaagagtaacacatgccgaatacccagagcagggcgccttgcaaggagctcagtgagcgcaggatgggggctttactgccagcgctccccttggccttacttcagacctcacggccggagcttgagaaattcctgctgccttctccaccccggtgggcagtttgatccagaaacctctgagagcagataccagatccatctgcccactgcacagagattgaccaaatactcaagtatttgccacatgaataaaatgaacaagaacacgaaacaactggggtcctccaggaatttcacttctaaatccttttctctttctttctggacacctccagtccagcgatatcaaaaaagcacagcaggcaatattagctact

SEQ ID NO: 82 - DNA, 765 bp, Homo sapiens
gtagccgaagctgcgtccgcaggagccggcccgaaagcctccgcacacgctgtggctgccgaagcccccggtgaggccgcggtagcaggagatgccacggtagggggcggcggtgatgcagcagcggccgggccggggcccgcaggccgagatgcagctgaaggcgcggccaccacagtaagatccacaagtcatggtgctttttggggaagagaggaggttctgaggatggagacgtccgaatggagagcacagtggtcggggcgtcaggcgttcactacttgcacctctgtaggccttttatataagtggggagactgtgaccacgtgggtcggagcaattagaaggctttatgggcttgggttgtttagctgctgtcgctccccacttaatgtacttaattggtgcccagaagcagccagatgttatgatctcttgccctaaactgcagttttcttcttcaaaggaccaactcacgtcccgcacacccacctcaacctcccaatacacagttgaggaaactgacgttggacgaaggagtgggcagtgactcaggttggaatggaagggaaggggcggggctgctgctctttctgtcctgcggggtttgacatggtcaatgccgctgtccgcggtgctcataggactagccaggaatgttgggagggggaatcccttgatgtggaacttggggggcgcttggtggtttctccgaactagatgacctgtttctgcaccccaaaagacccacgtttacagaatct

SEQ ID NO: 83 - DNA, 947 bp, Homo sapiens
ccgtctacaagaaaattgctccctttgaagctgccaggggggccgggaagcctgccccctcctgctcgcccgccctctccgccccaccagccccctccctcctttcctccctccccgccctctccccgctgtcccctccccgtcggcccgcctgcccagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtagggctggcttcaagctgcctcctcagcaacccagagatgcccctggctctgctgcctccgctgtcccaagccctggtcctgctgtccccagtgccgcgagggtgtccacagatttccccggtgctctctgtaggctgctgatccacgccccttcatcgccaccctgcggcccccttggtccctgtcaggcttctgcctcgtctcgccgccctccaggcacctttccctcaccccttcctctccctctcccttctgaccttgctctgcttcatccacctcttgtctctctgcctcccgctcggggtccgtcttcttggctaccaccctagagcgtggctgggtgactggtaccccagctttgccaatggccctgtttcatcattgcaagtcccaggcgcatgctccactccctcagcctcgctctgcccaggcgcctccttgctccagggcttggcgcctggcccgggttgggtcggatcggggaggaccgcccagcgcccaccgagctcagcacccaggagcagtcctccgctgcactgcctgaggccagtccttggcatgggctgaaagacttagtttcccaggcacaccccaggcaccctgcccagatgttcctcgc

SEQ ID NO: 84 - DNA, 775 bp, Homo sapiens
ggctgcccgtgcttcgtgctttggactaccgcccagcagtgtcctgccctctgcctgggcctcggtccctcctgcacctgctgcctggatccccggcctgcctgggcctgggccttggtgggtttggttttggtttccttctctgtctctgactctccatctgtcagtctcattgtctctgtcacacattctctgtttctgccatgattcctctctgttcccttcctgtctctctctgtctccctctgctcaccttggggtttctctgactgcatcttgtccccttctctgtcgatctctctctcgggggtcggggggtgctctctcccagggcgggaggtctgtcttccgccgcgtgccccgccccgctcactgtctctctctctctctctctttctctgcaggttctccccatgacaccacctgaacgtctcttcctcccaagggtgtgtggcaccaccctacacctcctccttctggggctgctgctggttctgctgcctggggcccaggtgaggcagcaggagaatgggggctgctggggtggctcagccaaaccttgagccctagagcccccctcaactctgttctcccctaggggctccctggtgttggcctcacaccttcagctgcccagactgcccgtcagcaccccaagatgcatcttgcccacagcaccctcaaacctgctgctcacctcattggtaaacatccacctgacctcccagacatgtccccaccagctctcctcctacccctgcctcaggaacccaag

SEQ ID NO: 85 - DNA, 765 bp, Homo sapiens
aggacgccgcgcctgtggccgcaagagcgctccgagcgctatgcgccggcggggcgcgagggctcgctctctcactcccacccgcgctggtccctcctccgcctccgccccctgcagctgcctgctgggccttgtagttccccagccgcggccccaaaggacggggagcgggccgagctgtccggcgctctgcccttctcttcctacagcctggtctcctttggcgtttgcgcccctgcatctgagcacgtcccagagggcgccggaatgtcaggccctagacatagcagcggtttgggggctagggggcaggtgaagagacgccgcagccttgaggttgtacctggtagcgtgggctttggagtctgtgcgccttggggaaatgattttcgcgctctaaatctctgttttcccatctgtaaatgggggataatagtgcttttcacatagagttgaggcgtcaacgagggcctagcgcatagttaacacttagtaaatacaagccggttttattataaggtcagcccctcctcaaacccttcccttggatttcagctttccccagccacataatttaggttttgtggtccaccgggaactggaccctgtaaattctacagcgatgctgttggcttccagaagtctccagcctgcagtgaatgtctaggaagcaaagagtaagcagtgggagttgaggggagacgtgtggttggtttggaaattaatcacagcccactcagaacaccctccagtactgtggaacac

SEQ ID NO: 86 - DNA, 908 bp, Homo sapiens
agaaagtactggagtctaaagaaacaagtagaaatcagtttgtagctattaccgttctacctgctaacaactcctgttttcaagttattatgtacaactttaggtagtttctctagccttaatcgtggtttctctgtattgagactacttttgaattctatgaagtacagccttagatgtacaggctactttaaatttttgcctaaaataaaaacattctctccaattacatatgctggggaggaaacacctgcttccgacaggtttaaagcttggttttggactttttgtgagagttccttatgtgtgcagtaatccaaaatttgtatagttgccctttataaaagtacattaatctagtagacaaatctccatgtaacttaattacatggcatcttctaatccttctgtgataagcagaaatgtaaagttttattcaagttaaggcaaactaacttgtatacactttccatctcgtgtttttcttgttgttgttaagtaggataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgagttattttacaagggtataaataggcctgaaaattagaagttagaagtaaatagaaattatttttagaaggtggtcgcaatgttttgattttgtatacctctttatattgtgatatgtacacgtttaaaaatttttctgtaattctcactatttttatcaagcttcatttttttctcatcagttattctttgaaataatcattctttatgc

SEQ ID NO: 87 - DNA, 855 bp, Homo sapiens
agtggggcccgccgttttcgccgctggctgaacaggtactcatacacggtcttatcgtcctggccagagcgggccttaatctcattaaagaacaggtcccgtttcttggtgcggccaaacaccaggaacagggccttctcgtggacctgccgggcggcgcggtcgaagcccaggccacggaggtccacggccctgccccgttcccaggcctccagctccaggcacagctgggccgagttcttaaagtttcggaagagcttccagatgtcgaacacctcccagccagatccgtccaggcctggcacggagcgcacatccagcaaggaggccggctgccggccgctggggcagctggacagcttcagctgggcagcccgcccgcctccgggggccgctggcttggccgtgtccgagggcttcttccgcaagatccgcagctcggcccccagcagcccatccttctccagggcactaatgtcaaacacgtacctctgcttcctgaccacgggacctcggtcatctagagagaacacccagaagtcattccctgcaacctcaccaagggagccagtcacttcgaggctgcgggggaaggccccagctctctccccgtccagagagctttctttcacctctgccccattctgacagaagccaagagccaaaccactgagagcctttttgaaaatgagagcatttcctacatagccgaccaagtaggggtgttcacctgaagatgtggctggggatgatttgcgtgattctggtgtttgtgtcatgatatacgtgttatcagagatttatcagctttgtaactgccttctacctatctctctcccagccatgagctaacgt

SEQ ID NO: 88 - DNA, 840 bp, Homo sapiens
gcccgcccgccgcccgcccggcctccggctctccctccctccctcctgtccctccctccctccctcctttgcgctgctcgctcgctcgctcgctcgctcgccctcagcgcatgggccccgcgccgggccccggggcctcgggccgccgggacgccggggtcccataggccggggcgtgggcggggcggccagcctgacgcagctctgcaccccctaccaccaccagggccggcggcggcggctgccccgagggacgcggccctaggcggtggcgatggggaccgcccggatcgcacccggcctggcgctcctgctctgctgccccgtgctcagctccgcgtacgcgctggtgagtcccccgccgccaacactccgggacaggctgcgggcttaccctagggtccgcgggataggtctaaggcacgcagtcttgagttcccccagtagttcgaactttgggtgagagtcccctctgatccaggatcctgggtgcctgctgtctctgggatgtctggactgtgggttccagctgcctgaagcctccctatttctgaagcctcgtttggggtcccaaatctggcaatttgtggttgagttttcaccatcctctgcttctgtgagcaccatggctgtttctccctggaagatgacagtgtgacccaacagaaggctgggctttggccctgctgcgtactcccacagactttgctttggggacctctgttttctgcaagttttgttgcagtcccggacacagggaatgtaggtctgaggtcagaatcatccaggcagggggtaggatttaggggccccctccagccctcacacacacacatgcac

SEQ ID NO: 89 - DNA, 871 bp, Homo sapiens
cctcttccccggcggcccctccctccttccctcctccctcgctcgcctccctttctggggatgggagccccgcccacatcctcccctccagccgcccgacctcgcctagcaggcccgggtcccggaagcccaggcagcgcccgagtccgcagctgccgtcggagctgggacgccgctgcctccagctctgggaagcggctggggctcacctggggaccacgtgcggaggtactagaaagcatgcaccgactagtcgccgtaccttccaaaaatacccatgggagtctgggcttccctgagtttagtgtaactgctgcccaaactgatgattaaaacactgagtaatcaccatttaccctgagtaattagagataatgaaacacctctaaaatcaggttatggagaaaggagctgttggatcggtttaaaaggtggccttccataaactgttaaaagatttccaaacgttgagaaacaggctgtgtgcagaactgtgtgccagagagagatacctcttgggctgttaaaaggtgaatttccttccaaaacattcttaaagtgcgttttgtagaacaccttggtgatgaccctgaggtagaccccagtaaatgagctcacttccctcctccccccaaggcctaaagacagaggtggcctgcagacaggctggggccacgttttttacagttagaaaaatctgtttctagctcagaagccgtcttaagaaccgacacagcagttatttttgttggtgttatggttgttgttgatttttttgttcatttttggtgtacctaagagtcctgacactctgtctttccaaggagataaccacagaagcagtaaccttttaggccacagggagacaaga

SEQ ID NO: 90 - DNA, 834 bp, Homo sapiens
cggctttctcgctcacatctgttcgagtggagcacttcactatggaattctcaacttttttcttttcagtggtcgtggagctgtgggactgggcctccatgatgtcttctcattacttcagctctcttcgaccaaaaatgccctaaagaaaacaacagagccatcaactttccaaaatggtggaaaaaaaaaaaaaactttcaaaagtccacttcacctgtcatctgagaaaagcctagagctttaggaaattcaaaatgtggatgacacttctccacaggttttctggcaaaaaaaaaagtctcaaaatttaacaaaccagtgaaactctacacaagcaaaaaagagaaccgagggaaatgcccataacatggtacttttcccaaatccctactgagcgtttggtatcaaacggtataaaaatctcaatttgcaactgtgtctatcatgtgaaacaagtgtcacattactttttaaagccacgtctgcaaatgtctcttcaggtggccaactttacaggaaggggcatttgaacaaattccaaagggagggaaggtttttaattattaattagatgttttaaagagagtccgacaatttctaacatcgaaggcctactccaaattctgaatcagaggataattcaggccaagtagtcagtgatttttgcctctttcataaagatatctgaattgcaatatacctcttaatcctaattcattctggtaagctatactctttaacctctttaaagcatgagaatatttcagttcatttaagttacacttttaagacaaaggtaatagaacaacacgctcttgattccacatggaa

SEQ ID NO: 91 - DNA, 660 bp, Homo sapiens
ctggttggaatgttatcgtctttcagatggcctctcctactggaagtttctgtaccctttatcagaagagaggcgcaggcggacggagggaagtcgagatgagcgctagggctgcaccttgctccagggccagctgggagggggagggtaccctaaagaggcgctgaggtctcagagggcctatcggaagccgttctttgtggcctgggatttcagcccaccagtgtcagagtgttagtcccctttgtctaactctgctttgagcccaccagccaccaagccttggacaggctgtgaagtcaaccctttggcgtttgcttgctccctcgctcgcgctctctctttcctacttcacctaagttcgatgagttgagatctgtttttgctgaactcgaagtgcttcgaagaggcgagctgtgtgcatgtgcgcctaattatcaaagctggtggaaaagagcccatttatatctgtgcgcaaacttctccgagccaacactttgcaagttcagtattctagcgcaacgtagggacctgcaaatacttgcaactgcgatgggcaccgaggaccctgggacagagtccttgattggcagaactcttcttggtgaacttctgcgtgtcctgtgcctaagtcggcgcgctacgaccccgggagccgtt

SEQ ID NO: 92 - DNA, 765 bp, Homo sapiens
acgtcccttgtcagaatgtccaaaaggtgcaggaagaaaggcaggctcttcctccagagcctgaagccctgcactaggcgtgcggtgcctcaggagcaggagcctcacggcccccaacagaaattctgatgcccagggagacccctgtgagtgcccctgacgtctagggggcacctctggcccacccttcgaaggaggcgtgtgatgggaaaggcagctggtgtggatgccctgggacaccgcacgtgctcagaaacgcggcgggaaggtcaaagtctcagagcaagcggctgggctgctgacctaggagtgtgctcccctggcttgaggttgggcgtcctcaccggtcactctaggggcctgaccaggtctgaggaagcccctcccagctacttactgaagtagaagccgcggtccccacagacgaactggagggtgtccaccagctccccgccgcacagggtctcactggggcggtaagcagcaatgcagcacgaggcgaaggccaagaaggtgagaagcaccagcatcgacttccccattgggattcccattggtgtctgggggcgggagagaagtggcgtgagcggggcagccaggccaagccccaggccagaggtgcccctcccaaaccaaatttgccaacctacaaattcagttgaaaattgaaagcacggctttcctataaacattatttttattacaaaagtaacacacaggtcataatgccgaggtgagggcgcagggccatgtgcagaatgaagc

SEQ ID NO: 93 - DNA, 715 bp, Homo sapiens
caggacctttgcacctgccatttctgctctccagaaagccctgcctcctccccatctttgtagtcataggtgtttcttgtcatttagagtttcagttcaaatatgacaccctcccattgatggaaatcatttcaccaccagacgttatgtggctcattgtttatccgctgcctgcctcccggctggagaggcgcagggagctgcctgtccctcctgttcagagccaccgttccgcacctggaccaccgcttggcagaggcgggagtggaggctgtcaccatcaggatgaaggacaggggtggcccggcgtggagaagctaagaagagatggcgataggtcaacgcgattgcgcctttaaggtggaagaaacgaagggcgagggtcagtaaagtcaaggacgggctcagatcccgccactggtgataagcgggacccataggaccgacgtgatcgcggccaggccctgggtggtttacctggacttttacctggctgccttttctctgcacccctccgtcctcactcccccagtcatcggcataggtcaagtcagagtgttgaagaaacacacgagtttggctctggaaaggaaaatcagaaaggcggcctaaggggccccacccccaggaacgctaagataggcggccaggggtgagcgggcagggccggccagcaggccctgaaagcagccgggccaccagcgcgtcccgagtc

SEQ ID NO: 94 - DNA, 759 bp, Homo sapiens
ttctttttttttcccaaaagagtacctctgatcattttagcctgcaactaatgatagagatattagggctagttaaccacagttttacaagactcctcttcccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacgccttgctcctgcttctgctacgaccttctggggaaaacgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggcccgcttctcttacaggtatgagctaatcttgaatgtgaactttttttgattgctagagattgccagcttaggaagtaatgttctacacctgtcatttgatttttctcttgctcaagccttaaaagagctgccaaccgcactgctgtttttcctgaaagacctggaatttcacatggttacttctaactttgccattggcttttaacattttcgtgttaatgttaattttcattttatgttaatgactctgcctatgaaatagtgtttctttattcttgtacaaataaaggtcagtactacaaccaa

SEQ ID NO: 95 - DNA, 654 bp, Homo sapiens
gacaagggggctcagcaggctctggttgaccgtaactgcggtgatgcctcccatgccgctggccccaccatagccgccgcccaggccaccgcgaaagttgctgctgcccactcgggagaagctcgaggagctgatgcgggaaccgggcccactcgtgtaggagcggctgctgaaggcccgggggccagaggtggacaccttgtaggacttctgggtcaccctgatggacatggtagaggcaggagtggaggcaggcgggccgaaccaggcggagatcctagaaggagcggagaagctgcttcttggtgaggagagctctcaggaatggccttttataaaagagatcccagccccgggggatgggggggaaaggcctcgtacctgagtggctaggcccagagggggctgggcctaacccgtcacctgccacctccgggcaggactcaggtgggggcagcagagagctgccgccacccaagggcccgttccaaccctggagcccactccagcaccacccccagaaacccaggaaaaggcagttcagtgaatatgaaactggaagaaatcctgtcctggcacaagtgcctgtaacaagcagacttgcctgggccgcccagccactacaaccctgactcctgggtcttgtctccctcc

SEQ ID NO: 96 - DNA, 817 bp, Homo sapiens
tcctcccaccttatatttatttattctttctaattttttccctccccttcttcactctttttctcctcttttcccctcttccagtcttctcccctcaactgcccacgactagttgccttccacgcctttcccagcctgggatagtctccagtcttcactccctctctgatcttgctatttaggtcactactcctctaaggagcacccattgctctggacactgagctgtgcacgctggggctgcagagaggagtctagcacagtctctgacctctggaagctcacagttccagtgggaaatcgctgctcatgaccagttccaagagaaatgcaagagaaggtggccagagctgtgggcagacaactgggcagagcacattcctgtgcatctgccccacgttcccctccctctcagctccggggaaggaagccgagtctgaccaccttacctctgggcttgcgtctttcttgcccgctgcttctcaaacaggcgtatctgtgtgaggacttggagctctgcaaccaggagcccagtggggagggtgctttgttccttctgcagagtcgtgcttaaatgaagagagacaggaagcccgatggcaaggctcctccacaccctaggcctgggccggccccaaacgtcaccagctggagctgggttccccaccccccaggctctcagggaacatgtcaaagtgaaaatgccaaagtcaagggaaaaagttaagcagaatcaggcttaaatcaggagtcaaactgtcactgccactgttaagcggcaagaaaaagatggcaagaaagattccattagtggtag

SEQ ID NO: 97 - DNA, 1155 bp, Homo sapiens
acagcagatgctgtagcatttctgccaaagaaagagtccagtataaacattctgcagtatgcaaatgtcatctcctctatgtgaatattttccccgagtggatgttgcagggttggaggcttctgcctatgatttaggttgtaattttatttgtggaaataaaccaatcgtggagctccaattgtcttggtggtgaggtgatcaatagcccattactggatagaacagcgactacaggaagagcattgaagattttaatgcatgaattatgcatgcagcgctcattctttagtctccgaacagaatgacagggtttgtgaagtcgcctcagatagtttcttgcattaagtgactgcagtgaaatgcttaatattttcaggcatagaagcagcattgactcgggccagccgaatttggaagatgtaaatctcccagctcacagcacggaatgctttatttgaaagtattgctatgtagacagccggcttttctgtcatctaacctgctctccccaggttggctgaaggatgggagcggctgtgcctgcctgtgaggtcacagcatgaagtccttttaacttgctttctgctgcaggagagaggcgtattgtggtataactgttgctgtatttattcaaatggacaatttgcaatagatattatacccaggacgacagataagtcaacacataaggtaagtccaaggttttttttataggttaggtaattgtaaactagaatatgctgagttaggataatggtgatgcgatattaataaggttgactcagaccttagtattgcaatgccagcatcaggactctcaattgttacgttaaacgagaggtgactttctatatttgatagtattggaccatagggtattttatcttgcatgcaaaagctttccaagaatgtactagagctcgaatgtgtagaagactgcaaactggggaggggcagcagtagaatgagctgaatcaataagtggaaattacctccttgtggggaagttttagcacggctgtggcatcgcgttggctcagattatttccttaatgtcaacattttcaaattctagtaaaagatgtgggtagacaccagaaatgctcaatccttctcccagaagcagaggaaagcaccgaggtactcaaactc

SEQ ID NO: 98 - DNA, 1093 bp, Homo sapiens
gccactgtcagcgaacgtgtccatcctcagcaagagagggcccgagccccaccctgcatcctccgggccagagaacagccctcggggcctcccagctcggcactggcctcacctctgtgcagcatgggctggccctgcagccccaggggccctgccttagacactcagcatgctgcccaaatgcccaattccttcttctcctctgacccctgcaactcctttaagcaaccccaagggacaaagtctccaatagagacttcaggttcctggaaagacgaaagcttgacggcaatgactgagcgaccctttacttggccctgatcctgagcaccagagttactccaatcttgtgaaagcagcaaatgtgctccaccaggaccttcccatgggcggccctgggcagaaaacccatgcaggttgttgcaccctgacctagtgtcaccacccagagagctcagagaacatctcccagcggagccgcccggcagggagctatgctagtcctcagcaaagacgcttctgcaaacaaagcggatcccgaatgggttttagaaggcggcagtaacttaaataaatcatgggccgaaacacactgccgcccggaatgcacagggcgcgtgtagcagccacagacacgcggtggaaaagtgctcacactcttaggcaatcatgaccttaaccaatttaaggaaatcccattgccataaagtgagaaagaaaaatcagcggaatcttccagagacctaaaacatgtacagaaaactggcgatcagcatgaacgtaagagccactaacgctacctagaaaggatcacttcaggttaagagcatttccttctagccccaaacctggaaaaacagaagagaaatcacacttacccctgagcaaacctgaaggcgtgtgtccctgggctcctcgattcaattaggtttgaataggatgcatacttttcccactcactgcgtctctttttctttttgcagcctttctccaccaaaaaagtggagactcagagctgcggaggaaaactcttgcagtccttgcaggaggctggagcccaggagaactgaacggcctttggtggaagactgag

SEQ ID NO: 99 - DNA, 960 bp, Homo sapiens
gcccacttcctggatctcattgtgttggaggtacaaggccgtgaggttctccagcccctccagagcattgttggggacccgtgagatctggttgtggtcgagatggagctctctcagggatcgaggcaggggaccgggcatccgggtcaggttgttgtggtccaggtacagcctctccaggtgcctcagcttggagaagaccttcctgcccaccttatcactggtgatctggttgccgtggagagcaatccagagcagccctgtggcattgtcaaagacgccttcctggatggaggtgatctggttgttctggaagtacacatacttcatgcgggagggaacgaagggcaggtacttgaggttgcgattgtcacagtacatggccgtggggaagttgggtgggcagtcgcactcctgggggcagtcgcggggatctggaggggatggagagccgtaggtgtaggctggcccttcatccaccccataggggtaaggctcgtaggtctcatacgggtaagggtcatagggatcgtagtaggtggactgctggctgcggaggtagtggaaccaccaatgagggtcatcttcatactgggcctgggagagggagaagagccctgccagcagcaggagggaggtccactgcattttgtctctgcaagaagcgggagagaacagagcaagccagcatgagtgagactccacagaggcagtgaggcagagtaggcaagccttaggctttgagctatgcagagctgacttccatgtcaaacatctgagagcaggagccttgctctcatttcttcggtgcctcctcccagtctggttctgcacttggtccagccggaccatggctatttggggtgagctaagtgcattttcccctggtcatagagtcacagacagaatgtctttgaatgggaacagctgcattttttttttggaggggcagattcttag

SEQ ID NO: 100 - DNA, 1100 bp, Homo sapiens
cttggcctcccaaagtgttgggattacaggtgcaagccactaagccaggcccagacccaacctctgactccagctctgtctctgacctaagccacatcaacccccacccccagacctagcttagcagtgacccagtccattccctctcccccaaccccaccctgaccctgacgactccagcctcccttagccccagccccttggctgagtcacccaacctttctgcacacaggcttcatcgcctcagacatgacctcccgcaactcgagcacgcagctgtggctcatcacgcactaccacgagcacggctccctctacgactttctgcagagacagacgctggagccccatctggctctgaggctagctgtgtccgcggcatgcggcctggcgcacctgcacgtggagatcttcggtacacagggcaaaccagccattgcccaccgcgacttcaagagccgcaatgtgctggtcaagagcaacctgcagtgttgcatcgccgacctgggtgagccgggcggggcaggggcgcgcccttcacaggtgggcggagcttgtgcgctctcctctcctttgcctgtgggcggtgaccatgattagcacttgaaaatttagaggtgcatgttgtttcagttctcctccgcaagaccccacgagttgtctgaacacccttttcaaacccagattccttccaccataccatcctggctccaggagttgggagaaaggaggcaggagccaggaacctgggttctcatcctggtttcgccagcctccaggtctgctctgtgaagtgggctcataatgcctgccttgcccactcacatctcgctgggttcttgggaacctagagagcactacacaagcaaagagtacctggggccatggttctctctgtggccactgccttccagcccatctccgtgcacgtctccatctgccttcccctctctgtcccactgtttctctcagtccccaccttgcctgccccctggatcccaggtttgggagaggggcaggagtgacaggcctcacccccacaggcctggctgtgatgcactcacagggcagcgattacctggacatcggcaacaacccga

SEQ ID NO: 101 - DNA, 735 bp, Homo sapiens
ccagaccccaatctaaacaatcttgattcctgttcctggcttggcaggaccctgaatggcaggaagcgaagacaggagcctgtttatgtttgaggcagccagggctgggggggcattgagaaagggtaggcaggggtggaagctgtgagggagtgggaaagagacacagaacagaaggggagctgctggagagatgctccttctaccccaattgggtgctccctgcggctctcccaacctgcctgcagtctgagctcagcagcaggagtgcagagctagggtttccccaagctctcagtcacttaaacattgctctccacccttcacctctaacaggatggtttccatggggaagtgaaccaggacttcccctgcaggccccgccccaaagccaggcggcagggagtagggaggcggcctccctgcctcccctccaaaaaaaactctgtgatttcctctgggcaggagggagccacggccagcggctgtcacacttcatggctcttactccacctctcttgctcctctctgcagggaccatgaccttgggctcccccaggaaaggccttctgatgctgctgatggccttggtgacccagggtgagtactgggggagcagttaggaaacaggaacctggatacagaaagggctatctgggcccagatcagctctgcctggggctgaacttgagaagctggggagaatgtaggagcttgactggagagtggaggaca

SEQ ID NO: 102 - DNA, 868 bp, Homo sapiens
gagaaatttaatatagatatatgaattttacgtagatataaagatattatgagaaaaattatgtttttgaattggtttgaatataggaaatattttttgtgtataggataaagatgtttgaaagatagaaagatgtatataatagtttttttttagtatttttattgtgatttagtagaaaagtttatatttatgattatttttaatagttattttttttttacgtttttaagtagtgattttttaatttaaaataaagatatataagaggttggtttcgttttagttttttttttttgttattaaatgatgttatttatattgagatgttttggtttgtgtttttgtgattgaagatataagaaagtttgggaggtcgaggcgggcggattacgaggttaggatattaagattattttgattaatacggtgaaatttcgtttttattaaaaatataaaaaattaattaggcgtagtggtgggcgtttgtagttttagttattcgggaggttgaggtaggagaatggcgtgaattcgggaggcggagtttgtcgtgagtcgagattgcgttattgtagtttagtttgggcgagagagggtgatttcgtcgtaaaaaaaaaaaaaaaaaagatgtaagaaataagaaagtaagtttgttattgtttatgtttataggatttatgtatatttgggaatatatatatgatatgagttgagtgaaaatttagtaatataaattagaagaaagagaaagatgaaaattagtttaaaggaggtaatttatttaaggaggaaagttttgtattgaggtataaggaagtgatttttattaattggtgtgaaatggggagaattttatgtgtatagg

SEQ ID NO: 103 - DNA, 868 bp, Homo sapiens
gagaaatttaatatagatatatgaattttatgtagatataaagatattatgagaaaaattatgtttttgaattggtttgaatataggaaatattttttgtgtataggataaagatgtttgaaagatagaaagatgtatataatagtttttttttagtatttttattgtgatttagtagaaaagtttatatttatgattatttttaatagttattttttttttatgtttttaagtagtgattttttaatttaaaataaagatatataagaggttggttttgttttagttttttttttttgttattaaatgatgttatttatattgagatgttttggtttgtgtttttgtgattgaagatataagaaagtttgggaggttgaggtgggtggattatgaggttaggatattaagattattttgattaatatggtgaaattttgtttttattaaaaatataaaaaattaattaggtgtagtggtgggtgtttgtagttttagttatttgggaggttgaggtaggagaatggtgtgaatttgggaggtggagtttgttgtgagttgagattgtgttattgtagtttagtttgggtgagagagggtgattttgttgtaaaaaaaaaaaaaaaaaagatgtaagaaataagaaagtaagtttgttattgtttatgtttataggatttatgtatatttgggaatatatatatgatatgagttgagtgaaaatttagtaatataaattagaagaaagagaaagatgaaaattagtttaaaggaggtaatttatttaaggaggaaagttttgtattgaggtataaggaagtgatttttattaattggtgtgaaatggggagaattttatgtgtatagg

SEQ ID NO: 104 - DNA, 1079 bp, Homo sapiens
cggggagagcgaatgttttcgtagtgtattattttagtaggggtggagggagtcgacgcgtttgtagagatgtttagtatgggtaattaaggcggtagaaataatttataattttgttttgttttaagtcgtttttttttattttttttatttttcgtttatcgtttaagttttatttttgttttaaaatatatgtgtttttttgttttatagagggagggatgaaagacggttaggaatttttaggtatattttatatttaaattttgtggattttttatggaaggaatttgtgtgggtgtttgtggtgtatttttggtgatattcgtttatatttagtcggtgtggatggaaatttaagtaggtatgtagaatttaatattttttattcgtttttgaaatgttttttaaacgtttcgaaataagaaatgaagatttttaatttttttataattttattatcgatattttttggaataatggaattttatgttaataggttatgttatatttgtaaaatatataaaatgtttataattgtagaattatttaaagttttaagtttattattagagaagatttttttttaatgtgtttggttgtgaggaaagatttgatttttttaattgattagatttaaaaaaaatgtgatagcgattaaagtattttgtttgtttttgaatttggggtttttgtttttattttattgtaaagaagtataaaatgaattaaatagtaattagttattttatttttgagttgtaattaattaggaaatttattatttaaaaatgaaaggatatgttatttatgtttttatatgtagttaaaagttaaagtattatttgaaattattttaaaaaaaaagttggagtatatttgaaggggtataggttaaaattaaaatggagaggggaatgtgggttgggagtaagagggaggagaaagggaaatggatggaatgttgaaagagttgattatttagttagagagaagatataaaagtataaaagaattataaaggataggttattgttggtagtaaaaatttttggaataaaagattagttttaattaag

SEQ ID NO: 105 - DNA, 1079 bp, Homo sapiens
tggggagagtgaatgtttttgtagtgtattattttagtaggggtggagggagttgatgtgtttgtagagatgtttagtatgggtaattaaggtggtagaaataatttataattttgttttgttttaagttgtttttttttattttttttattttttgtttattgtttaagttttatttttgttttaaaatatatgtgtttttttgttttatagagggagggatgaaagatggttaggaatttttaggtatattttatatttaaattttgtggattttttatggaaggaatttgtgtgggtgtttgtggtgtatttttggtgatatttgtttatatttagttggtgtggatggaaatttaagtaggtatgtagaatttaatattttttatttgtttttgaaatgttttttaaatgttttgaaataagaaatgaagatttttaatttttttataattttattattgatattttttggaataatggaattttatgttaataggttatgttatatttgtaaaatatataaaatgtttataattgtagaattatttaaagttttaagtttattattagagaagatttttttttaatgtgtttggttgtgaggaaagatttgatttttttaattgattagatttaaaaaaaatgtgatagtgattaaagtattttgtttgtttttgaatttggggtttttgtttttattttattgtaaagaagtataaaatgaattaaatagtaattagttattttatttttgagttgtaattaattaggaaatttattatttaaaaatgaaaggatatgttatttatgtttttatatgtagttaaaagttaaagtattatttgaaattattttaaaaaaaaagttggagtatatttgaaggggtataggttaaaattaaaatggagaggggaatgtgggttgggagtaagagggaggagaaagggaaatggatggaatgttgaaagagttgattatttagttagagagaagatataaaagtataaaagaattataaaggataggttattgttggtagtaaaaatttttggaataaaagattagttttaattaag

SEQ ID NO: 106 - DNA, 741 bp, Homo sapiens
ataggtaaataaggagatgtttttatagttttttgagttttgtttattttttttagagttttagttttgtttaattttggttttaaaaatatgataattagttattgagggtttaaggataatgattttatgtgttttttttttgtaggtgtattatttggattatgaggttatttttttgttggttttttttattttttattttggttttagtggtttaaggttagttaataagacgattaagattcgggattgggttcgggcgtagatttaggtttaggtttaggtttatatttagttttttttagtttgatgaattagtagagttaatagatttgtttttttttttttttttaggttttttatttattttttttgattgttttcgcgaatgttattgtttttttgattttttatttgttttttattgtgatagtcgtaatttgcgaaaggtttttgttatttcgtttcgtatttattatttttatttttagaataattttattattgagttttcggtggagtttttttagaatgttataggtttgcgatggattaatttggataataatcgaattcgtaagatagattagagggtgttggagaaattgttcggtttggtgtttttttatatggagaagaattagttggaagaggttttttcggttttgtttcggaatttggagtagttgaggttgagttagaattatatttttagaatttcgtttggtgtttttagta

SEQ ID NO: 107 - DNA, 741 bp, Homo sapiens
ataggtaaataaggagatgtttttatagttttttgagttttgtttattttttttagagttttagttttgtttaattttggttttaaaaatatgataattagttattgagggtttaaggataatgattttatgtgttttttttttgtaggtgtattatttggattatgaggttatttttttgttggttttttttattttttattttggttttagtggtttaaggttagttaataagatgattaagatttgggattgggtttgggtgtagatttaggtttaggtttaggtttatatttagttttttttagtttgatgaattagtagagttaatagatttgtttttttttttttttttaggttttttatttattttttttgattgtttttgtgaatgttattgtttttttgattttttatttgttttttattgtgatagttgtaatttgtgaaaggtttttgttattttgttttgtatttattatttttatttttagaataattttattattgagtttttggtggagtttttttagaatgttataggtttgtgatggattaatttggataataattgaatttgtaagatagattagagggtgttggagaaattgtttggtttggtgtttttttatatggagaagaattagttggaagaggtttttttggttttgttttggaatttggagtagttgaggttgagttagaattatatttttagaattttgtttggtgtttttagta

SEQ ID NO: 108 - DNA, 731 bp, Homo sapiens
tttatgtaggttttaatataatgaaatttattttataggttttattatatatgtaagtgatgtagttattaaattaaatgagatgatatatgtgaaaggttttggtaaagtattatataaagtaatatgttagtattattttagttagatttagataatttttagtataagatgatttaaaagttagagagtggaaaaggattattatatttttatttttagtcgtttatataattattttttatttgtgtcgtgatttagtattttgatgttatagacgaggatattattttatatatggaaagcgaggagttgaatggtgtatataaggttattttcgttgtttaggatttgaacgcgttttttgattgggatagtcgtgggaaggatagttatgaaacgagttagttggatgattagagtgttgaaatttatagttataagtagtttagattatataagcggaaagttaatgatgagagtaatgagtatttcgatgtgattgatagttaggaattttttaaagttagtcgtgaattttatagttatgaattttatagttatgaagatatgttggttgtagattttaaaagtaaggaagaagataaatatttgaaatttcgtattttttatgaattagatagtgtattttttgaggttaattaaaaggagaaaaaatataattttttattttgtatttagttaaaagaaaaaatgttttatagtaaaat

SEQ ID NO: 109 - DNA, 731 bp, Homo sapiens
tttatgtaggttttaatataatgaaatttattttataggttttattatatatgtaagtgatgtagttattaaattaaatgagatgatatatgtgaaaggttttggtaaagtattatataaagtaatatgttagtattattttagttagatttagataatttttagtataagatgatttaaaagttagagagtggaaaaggattattatatttttatttttagttgtttatataattattttttatttgtgttgtgatttagtattttgatgttatagatgaggatattattttatatatggaaagtgaggagttgaatggtgtatataaggttatttttgttgtttaggatttgaatgtgttttttgattgggatagttgtgggaaggatagttatgaaatgagttagttggatgattagagtgttgaaatttatagttataagtagtttagattatataagtggaaagttaatgatgagagtaatgagtattttgatgtgattgatagttaggaattttttaaagttagttgtgaattttatagttatgaattttatagttatgaagatatgttggttgtagattttaaaagtaaggaagaagataaatatttgaaattttgtattttttatgaattagatagtgtattttttgaggttaattaaaaggagaaaaaatataattttttattttgtatttagttaaaagaaaaaatgttttatagtaaaat

SEQ ID NO: 110 - DNA, 842 bp, Homo sapiens
tttaaaggggcgtttgtgcggcgtttgtcgagcgtgagagtcgtttcggcgtcggttttttattttagattcgacgcgtcgaagttggttttgggtagattcgagttttttttttattttcgggcgcgtttttattttttttttttaatttcgtttgcgtttttgtcgtcggcgtttttattttttttttttatcgttgaaggttaagtagagaagtgggaagtgggggagagtggtttataggaatggtaaatatatttggaaattataggttataagtatagtcgtattatttttttttttttatcgtttcgaaatatttttattttttatttttaattttagtggttaggattcgtttttgaggggttttagggtggcggttgagtggcgtcgaggtgtatttggtagatgttatattcgggcggtggttttaggattgtgaggaggggtgcgggagggggtggggtaggtcgagggattagttttggacggttttggttgttagattttaagttttgtgggtagtttcgttttagttcgttagatttttgtgtgtttatttgttagttacgatgttcggatttttgtggaaaggggagggtgagtaggtagggttatagttttggttttagggtgagttttaagttgtttggtataggatattgtttgtgatgaggggtggaaggagaaattagaatttatattgaattaaattttagtcgtgttagagttagagtagttgatatgggggaagtttggtgtagggaggaggatggatgagatttggtattcgttgattaaaggggatttaggatacggggtaattagttttttttttt

SEQ ID NO: 111 - DNA, 842 bp, Homo sapiens
tttaaaggggtgtttgtgtggtgtttgttgagtgtgagagttgttttggtgttggttttttattttagatttgatgtgttgaagttggttttgggtagatttgagttttttttttatttttgggtgtgtttttattttttttttttaattttgtttgtgtttttgttgttggtgtttttattttttttttttattgttgaaggttaagtagagaagtgggaagtgggggagagtggtttataggaatggtaaatatatttggaaattataggttataagtatagttgtattatttttttttttttattgttttgaaatatttttattttttatttttaattttagtggttaggatttgtttttgaggggttttagggtggtggttgagtggtgttgaggtgtatttggtagatgttatatttgggtggtggttttaggattgtgaggaggggtgtgggagggggtggggtaggttgagggattagttttggatggttttggttgttagattttaagttttgtgggtagttttgttttagtttgttagatttttgtgtgtttatttgttagttatgatgtttggatttttgtggaaaggggagggtgagtaggtagggttatagttttggttttagggtgagttttaagttgtttggtataggatattgtttgtgatgaggggtggaaggagaaattagaatttatattgaattaaattttagttgtgttagagttagagtagttgatatgggggaagtttggtgtagggaggaggatggatgagatttggtatttgttgattaaaggggatttaggatatggggtaattagttttttttttt

SEQ ID NO: 112 - DNA, 859 bp, Homo sapiens
gaggaattggggagaaaggggatttaatttttgttttttacgagtttttggtttagtggtagagatagataagtatattaattattataaagtttgtagtaaatatattaagataaaaataaggtaatgtgggaaaatagtagaggttgatttagttgcgggaaattaggaaagaatttaaaaaagagggaatggagggtgggttatatagattttgtttttaaggagttagaggtggagtagagtgagttttggatcgttttttttttttttcgttttcgtgttttttaacgtttgtattgtaggatttcggttaggtttttggatgttttttggtttttgtttgtagaggttggtttttttgaggtatgtatgcgtcggcgtggagttattatttaaagttttgattagaaaggaatatagttttttttttgttatttgggaattttttgtaatttgattacgtttttgggtagagatttaaagagtaatatatgtcgaatatttagagtagggcgttttgtaaggagtttagtgagtgtaggatgggggttttattgttagcgttttttttggttttattttagattttacggtcggagtttgagaaatttttgttgttttttttatttcggtgggtagtttgatttagaaatttttgagagtagatattagatttatttgtttattgtatagagattgattaaatatttaagtatttgttatatgaataaaatgaataagaatacgaaataattggggttttttaggaattttatttttaaatttttttttttttttttttggatatttttagtttagcgatattaaaaaagtatagtaggtaatattagttatt

SEQ ID NO: 113 - DNA, 859 bp, Homo sapiens
gaggaattggggagaaaggggatttaatttttgttttttatgagtttttggtttagtggtagagatagataagtatattaattattataaagtttgtagtaaatatattaagataaaaataaggtaatgtgggaaaatagtagaggttgatttagttgtgggaaattaggaaagaatttaaaaaagagggaatggagggtgggttatatagattttgtttttaaggagttagaggtggagtagagtgagttttggattgtttttttttttttttgtttttgtgttttttaatgtttgtattgtaggattttggttaggtttttggatgttttttggtttttgtttgtagaggttggtttttttgaggtatgtatgtgttggtgtggagttattatttaaagttttgattagaaaggaatatagttttttttttgttatttgggaattttttgtaatttgattatgtttttgggtagagatttaaagagtaatatatgttgaatatttagagtagggtgttttgtaaggagtttagtgagtgtaggatgggggttttattgttagtgttttttttggttttattttagattttatggttggagtttgagaaatttttgttgttttttttattttggtgggtagtttgatttagaaatttttgagagtagatattagatttatttgtttattgtatagagattgattaaatatttaagtatttgttatatgaataaaatgaataagaatatgaaataattggggttttttaggaattttatttttaaatttttttttttttttttttggatatttttagtttagtgatattaaaaaagtatagtaggtaatattagttatt

SEQ ID NO: 114 - DNA, 765 bp, Homo sapiens
gtagtcgaagttgcgttcgtaggagtcggttcgaaagttttcgtatacgttgtggttgttgaagttttcggtgaggtcgcggtagtaggagatgttacggtagggggcggcggtgatgtagtagcggtcgggtcggggttcgtaggtcgagatgtagttgaaggcgcggttattatagtaagatttataagttatggtgttttttggggaagagaggaggttttgaggatggagacgtttgaatggagagtatagtggtcggggcgttaggcgtttattatttgtatttttgtaggttttttatataagtggggagattgtgattacgtgggtcggagtaattagaaggttttatgggtttgggttgtttagttgttgtcgttttttatttaatgtatttaattggtgtttagaagtagttagatgttatgattttttgttttaaattgtagtttttttttttaaaggattaatttacgtttcgtatatttattttaattttttaatatatagttgaggaaattgacgttggacgaaggagtgggtagtgatttaggttggaatggaagggaaggggcggggttgttgttttttttgttttgcggggtttgatatggttaatgtcgttgttcgcggtgtttataggattagttaggaatgttgggagggggaattttttgatgtggaatttggggggcgtttggtggttttttcgaattagatgatttgtttttgtattttaaaagatttacgtttatagaattt

SEQ ID NO: 115 - DNA, 765 bp, Homo sapiens
gtagttgaagttgtgtttgtaggagttggtttgaaagtttttgtatatgttgtggttgttgaagtttttggtgaggttgtggtagtaggagatgttatggtagggggtggtggtgatgtagtagtggttgggttggggtttgtaggttgagatgtagttgaaggtgtggttattatagtaagatttataagttatggtgttttttggggaagagaggaggttttgaggatggagatgtttgaatggagagtatagtggttggggtgttaggtgtttattatttgtatttttgtaggttttttatataagtggggagattgtgattatgtgggttggagtaattagaaggttttatgggtttgggttgtttagttgttgttgttttttatttaatgtatttaattggtgtttagaagtagttagatgttatgattttttgttttaaattgtagtttttttttttaaaggattaatttatgttttgtatatttattttaattttttaatatatagttgaggaaattgatgttggatgaaggagtgggtagtgatttaggttggaatggaagggaaggggtggggttgttgttttttttgttttgtggggtttgatatggttaatgttgttgtttgtggtgtttataggattagttaggaatgttgggagggggaattttttgatgtggaatttggggggtgtttggtggtttttttgaattagatgatttgtttttgtattttaaaagatttatgtttatagaattt

SEQ ID NO: 116 - DNA, 947 bp, Homo sapiens
tcgtttataagaaaattgttttttttgaagttgttaggggggtcgggaagtttgtttttttttgttcgttcgtttttttcgttttattagtttttttttttttttttttttttttcgtttttttttcgttgtttttttttcgtcggttcgtttgtttagtttttagtttttcgttcgtcgtttttgtttttttttttttataaattgtttaggagtgagtagttgttttcggttcgtcggatatatcggatagatagacgtgcggacggtttattattttagttcgttaattagttagtttgcgtttggcgttttttttttttaggtagggttggttttaagttgtttttttagtaatttagagatgtttttggttttgttgttttcgttgttttaagttttggttttgttgtttttagtgtcgcgagggtgtttatagattttttcggtgttttttgtaggttgttgatttacgtttttttatcgttattttgcggtttttttggtttttgttaggtttttgtttcgtttcgtcgttttttaggtattttttttttattttttttttttttttttttttttgattttgttttgttttatttattttttgtttttttgtttttcgttcggggttcgtttttttggttattattttagagtgtggttgggtgattggtattttagttttgttaatggttttgttttattattgtaagttttaggcgtatgttttatttttttagtttcgttttgtttaggcgtttttttgttttagggtttggcgtttggttcgggttgggtcggatcggggaggatcgtttagcgtttatcgagtttagtatttaggagtagtttttcgttgtattgtttgaggttagtttttggtatgggttgaaagatttagttttttaggtatattttaggtattttgtttagatgtttttcgt

SEQ ID NO: 117 - DNA, 947 bp, Homo sapiens
ttgtttataagaaaattgttttttttgaagttgttaggggggttgggaagtttgtttttttttgtttgtttgttttttttgttttattagttttttttttttttttttttttttttgttttttttttgttgttttttttttgttggtttgtttgtttagtttttagttttttgtttgttgtttttgtttttttttttttataaattgtttaggagtgagtagttgtttttggtttgttggatatattggatagatagatgtgtggatggtttattattttagtttgttaattagttagtttgtgtttggtgttttttttttttaggtagggttggttttaagttgtttttttagtaatttagagatgtttttggttttgttgtttttgttgttttaagttttggttttgttgtttttagtgttgtgagggtgtttatagatttttttggtgttttttgtaggttgttgatttatgtttttttattgttattttgtggtttttttggtttttgttaggtttttgttttgttttgttgttttttaggtattttttttttattttttttttttttttttttttttgattttgttttgttttatttattttttgtttttttgttttttgtttggggtttgtttttttggttattattttagagtgtggttgggtgattggtattttagttttgttaatggttttgttttattattgtaagttttaggtgtatgttttatttttttagttttgttttgtttaggtgtttttttgttttagggtttggtgtttggtttgggttgggttggattggggaggattgtttagtgtttattgagtttagtatttaggagtagttttttgttgtattgtttgaggttagtttttggtatgggttgaaagatttagttttttaggtatattttaggtattttgtttagatgttttttgt

SEQ ID NO: 118 - DNA, 775 bp, Homo sapiens
ggttgttcgtgtttcgtgttttggattatcgtttagtagtgttttgttttttgtttgggtttcggttttttttgtatttgttgtttggattttcggtttgtttgggtttgggttttggtgggtttggttttggtttttttttttgtttttgattttttatttgttagttttattgtttttgttatatattttttgtttttgttatgatttttttttgttttttttttgtttttttttgtttttttttgtttattttggggtttttttgattgtattttgtttttttttttgtcgatttttttttcgggggtcggggggtgtttttttttagggcgggaggtttgtttttcgtcgcgtgtttcgtttcgtttattgtttttttttttttttttttttttttgtaggttttttttatgatattatttgaacgttttttttttttaagggtgtgtggtattattttatattttttttttttggggttgttgttggttttgttgtttggggtttaggtgaggtagtaggagaatgggggttgttggggtggtttagttaaattttgagttttagagttttttttaattttgtttttttttaggggttttttggtgttggttttatatttttagttgtttagattgttcgttagtattttaagatgtattttgtttatagtatttttaaatttgttgtttattttattggtaaatatttatttgattttttagatatgtttttattagttttttttttatttttgttttaggaatttaag

SEQ ID NO: 119 - DNA, 775 bp, Homo sapiens
ggttgtttgtgttttgtgttttggattattgtttagtagtgttttgttttttgtttgggttttggttttttttgtatttgttgtttggatttttggtttgtttgggtttgggttttggtgggtttggttttggtttttttttttgtttttgattttttatttgttagttttattgtttttgttatatattttttgtttttgttatgatttttttttgttttttttttgtttttttttgtttttttttgtttattttggggtttttttgattgtattttgtttttttttttgttgattttttttttgggggttggggggtgtttttttttagggtgggaggtttgttttttgttgtgtgttttgttttgtttattgtttttttttttttttttttttttttgtaggttttttttatgatattatttgaatgttttttttttttaagggtgtgtggtattattttatattttttttttttggggttgttgttggttttgttgtttggggtttaggtgaggtagtaggagaatgggggttgttggggtggtttagttaaattttgagttttagagttttttttaattttgtttttttttaggggttttttggtgttggttttatatttttagttgtttagattgtttgttagtattttaagatgtattttgtttatagtatttttaaatttgttgtttattttattggtaaatatttatttgattttttagatatgtttttattagttttttttttatttttgttttaggaatttaag

SEQ ID NO: 120 - DNA, 765 bp, Homo sapiens
aggacgtcgcgtttgtggtcgtaagagcgtttcgagcgttatgcgtcggcggggcgcgagggttcgtttttttatttttattcgcgttggtttttttttcgttttcgttttttgtagttgtttgttgggttttgtagttttttagtcgcggttttaaaggacggggagcgggtcgagttgttcggcgttttgtttttttttttttatagtttggttttttttggcgtttgcgtttttgtatttgagtacgttttagagggcgtcggaatgttaggttttagatatagtagcggtttgggggttagggggtaggtgaagagacgtcgtagttttgaggttgtatttggtagcgtgggttttggagtttgtgcgttttggggaaatgattttcgcgttttaaatttttgtttttttatttgtaaatgggggataatagtgttttttatatagagttgaggcgttaacgagggtttagcgtatagttaatatttagtaaatataagtcggttttattataaggttagtttttttttaaattttttttttggattttagttttttttagttatataatttaggttttgtggtttatcgggaattggattttgtaaattttatagcgatgttgttggtttttagaagtttttagtttgtagtgaatgtttaggaagtaaagagtaagtagtgggagttgaggggagacgtgtggttggtttggaaattaattatagtttatttagaatattttttagtattgtggaatat

SEQ ID NO: 121 - DNA, 765 bp, Homo sapiens
aggatgttgtgtttgtggttgtaagagtgttttgagtgttatgtgttggtggggtgtgagggtttgtttttttatttttatttgtgttggttttttttttgtttttgttttttgtagttgtttgttgggttttgtagttttttagttgtggttttaaaggatggggagtgggttgagttgtttggtgttttgtttttttttttttatagtttggttttttttggtgtttgtgtttttgtatttgagtatgttttagagggtgttggaatgttaggttttagatatagtagtggtttgggggttagggggtaggtgaagagatgttgtagttttgaggttgtatttggtagtgtgggttttggagtttgtgtgttttggggaaatgatttttgtgttttaaatttttgtttttttatttgtaaatgggggataatagtgttttttatatagagttgaggtgttaatgagggtttagtgtatagttaatatttagtaaatataagttggttttattataaggttagtttttttttaaattttttttttggattttagttttttttagttatataatttaggttttgtggtttattgggaattggattttgtaaattttatagtgatgttgttggtttttagaagtttttagtttgtagtgaatgtttaggaagtaaagagtaagtagtgggagttgaggggagatgtgtggttggtttggaaattaattatagtttatttagaatattttttagtattgtggaatat

SEQ ID NO: 122 - DNA, 908 bp, Homo sapiens
agaaagtattggagtttaaagaaataagtagaaattagtttgtagttattatcgttttatttgttaataatttttgtttttaagttattatgtataattttaggtagtttttttagttttaatcgtggtttttttgtattgagattatttttgaattttatgaagtatagttttagatgtataggttattttaaatttttgtttaaaataaaaatattttttttaattatatatgttggggaggaaatatttgttttcgataggtttaaagtttggttttggattttttgtgagagttttttatgtgtgtagtaatttaaaatttgtatagttgttttttataaaagtatattaatttagtagataaatttttatgtaatttaattatatggtattttttaatttttttgtgataagtagaaatgtaaagttttatttaagttaaggtaaattaatttgtatatattttttatttcgtgttttttttgttgttgttaagtaggataagttttgaacgtcgaaaagaaaagtttcgagatgtagttagatttcggcgaagtaaagaatttgaagttttttatgagtttgtttattagttgttatttttatataatgtgagttcgtattttgataaggtttttgtgatgaggtttattattagttatttgcgtgtgaggaaatttttggatgttggtgagttattttataagggtataaataggtttgaaaattagaagttagaagtaaatagaaattatttttagaaggtggtcgtaatgttttgattttgtatatttttttatattgtgatatgtatacgtttaaaaatttttttgtaatttttattatttttattaagttttattttttttttattagttattttttgaaataattattttttatgt

SEQ ID NO: 123 - DNA, 908 bp, Homo sapiens
agaaagtattggagtttaaagaaataagtagaaattagtttgtagttattattgttttatttgttaataatttttgtttttaagttattatgtataattttaggtagtttttttagttttaattgtggtttttttgtattgagattatttttgaattttatgaagtatagttttagatgtataggttattttaaatttttgtttaaaataaaaatattttttttaattatatatgttggggaggaaatatttgtttttgataggtttaaagtttggttttggattttttgtgagagttttttatgtgtgtagtaatttaaaatttgtatagttgttttttataaaagtatattaatttagtagataaatttttatgtaatttaattatatggtattttttaatttttttgtgataagtagaaatgtaaagttttatttaagttaaggtaaattaatttgtatatattttttattttgtgttttttttgttgttgttaagtaggataagttttgaatgttgaaaagaaaagttttgagatgtagttagattttggtgaagtaaagaatttgaagttttttatgagtttgtttattagttgttatttttatataatgtgagtttgtattttgataaggtttttgtgatgaggtttattattagttatttgtgtgtgaggaaatttttggatgttggtgagttattttataagggtataaataggtttgaaaattagaagttagaagtaaatagaaattatttttagaaggtggttgtaatgttttgattttgtatatttttttatattgtgatatgtatatgtttaaaaatttttttgtaatttttattatttttattaagttttattttttttttattagttattttttgaaataattattttttatgt

SEQ ID NO: 124 - DNA, 855 bp, Homo sapiens
agtggggttcgtcgttttcgtcgttggttgaataggtatttatatacggttttatcgttttggttagagcgggttttaattttattaaagaataggtttcgttttttggtgcggttaaatattaggaatagggttttttcgtggatttgtcgggcggcgcggtcgaagtttaggttacggaggtttacggttttgtttcgtttttaggtttttagttttaggtatagttgggtcgagtttttaaagtttcggaagagtttttagatgtcgaatattttttagttagattcgtttaggtttggtacggagcgtatatttagtaaggaggtcggttgtcggtcgttggggtagttggatagttttagttgggtagttcgttcgttttcgggggtcgttggtttggtcgtgttcgagggtttttttcgtaagattcgtagttcggtttttagtagtttatttttttttagggtattaatgttaaatacgtatttttgttttttgattacgggatttcggttatttagagagaatatttagaagttattttttgtaattttattaagggagttagttatttcgaggttgcgggggaaggttttagtttttttttcgtttagagagtttttttttatttttgttttattttgatagaagttaagagttaaattattgagagtttttttgaaaatgagagtattttttatatagtcgattaagtaggggtgtttatttgaagatgtggttggggatgatttgcgtgattttggtgtttgtgttatgatatacgtgttattagagatttattagttttgtaattgttttttatttattttttttttagttatgagttaacgt

SEQ ID NO: 125 - DNA, 855 bp, Homo sapiens
agtggggtttgttgtttttgttgttggttgaataggtatttatatatggttttattgttttggttagagtgggttttaattttattaaagaataggttttgttttttggtgtggttaaatattaggaatagggtttttttgtggatttgttgggtggtgtggttgaagtttaggttatggaggtttatggttttgttttgtttttaggtttttagttttaggtatagttgggttgagtttttaaagttttggaagagtttttagatgttgaatattttttagttagatttgtttaggtttggtatggagtgtatatttagtaaggaggttggttgttggttgttggggtagttggatagttttagttgggtagtttgtttgtttttgggggttgttggtttggttgtgtttgagggttttttttgtaagatttgtagtttggtttttagtagtttatttttttttagggtattaatgttaaatatgtatttttgttttttgattatgggattttggttatttagagagaatatttagaagttattttttgtaattttattaagggagttagttattttgaggttgtgggggaaggttttagttttttttttgtttagagagtttttttttatttttgttttattttgatagaagttaagagttaaattattgagagtttttttgaaaatgagagtattttttatatagttgattaagtaggggtgtttatttgaagatgtggttggggatgatttgtgtgattttggtgtttgtgttatgatatatgtgttattagagatttattagttttgtaattgttttttatttattttttttttagttatgagttaatgt

SEQ ID NO: 126 - DNA, 840 bp, Homo sapiens
gttcgttcgtcgttcgttcggttttcggtttttttttttttttttttgttttttttttttttttttttttgcgttgttcgttcgttcgttcgttcgttcgtttttagcgtatgggtttcgcgtcgggtttcggggtttcgggtcgtcgggacgtcggggttttataggtcggggcgtgggcggggcggttagtttgacgtagttttgtattttttattattattagggtcggcggcggcggttgtttcgagggacgcggttttaggcggtggcgatggggatcgttcggatcgtattcggtttggcgtttttgttttgttgtttcgtgtttagtttcgcgtacgcgttggtgagttttttgtcgttaatatttcgggataggttgcgggtttattttagggttcgcgggataggtttaaggtacgtagttttgagtttttttagtagttcgaattttgggtgagagttttttttgatttaggattttgggtgtttgttgtttttgggatgtttggattgtgggttttagttgtttgaagtttttttatttttgaagtttcgtttggggttttaaatttggtaatttgtggttgagtttttattattttttgtttttgtgagtattatggttgtttttttttggaagatgatagtgtgatttaatagaaggttgggttttggttttgttgcgtatttttatagattttgttttggggatttttgttttttgtaagttttgttgtagtttcggatatagggaatgtaggtttgaggttagaattatttaggtagggggtaggatttaggggttttttttagtttttatatatatatatgtat

SEQ ID NO: 127 - DNA, 840 bp, Homo sapiens
gtttgtttgttgtttgtttggtttttggtttttttttttttttttttgttttttttttttttttttttttgtgttgtttgtttgtttgtttgtttgtttgtttttagtgtatgggttttgtgttgggttttggggttttgggttgttgggatgttggggttttataggttggggtgtgggtggggtggttagtttgatgtagttttgtattttttattattattagggttggtggtggtggttgttttgagggatgtggttttaggtggtggtgatggggattgtttggattgtatttggtttggtgtttttgttttgttgttttgtgtttagttttgtgtatgtgttggtgagttttttgttgttaatattttgggataggttgtgggtttattttagggtttgtgggataggtttaaggtatgtagttttgagtttttttagtagtttgaattttgggtgagagttttttttgatttaggattttgggtgtttgttgtttttgggatgtttggattgtgggttttagttgtttgaagtttttttatttttgaagttttgtttggggttttaaatttggtaatttgtggttgagtttttattattttttgtttttgtgagtattatggttgtttttttttggaagatgatagtgtgatttaatagaaggttgggttttggttttgttgtgtatttttatagattttgttttggggatttttgttttttgtaagttttgttgtagttttggatatagggaatgtaggtttgaggttagaattatttaggtagggggtaggatttaggggttttttttagtttttatatatatatatgtat

SEQ ID NO: 128 - DNA, 871 bp, Homo sapiens
tttttttttcggcggttttttttttttttttttttttttcgttcgtttttttttttggggatgggagtttcgtttatatttttttttttagtcgttcgatttcgtttagtaggttcgggtttcggaagtttaggtagcgttcgagttcgtagttgtcgtcggagttgggacgtcgttgtttttagttttgggaagcggttggggtttatttggggattacgtgcggaggtattagaaagtatgtatcgattagtcgtcgtattttttaaaaatatttatgggagtttgggtttttttgagtttagtgtaattgttgtttaaattgatgattaaaatattgagtaattattatttattttgagtaattagagataatgaaatatttttaaaattaggttatggagaaaggagttgttggatcggtttaaaaggtggttttttataaattgttaaaagatttttaaacgttgagaaataggttgtgtgtagaattgtgtgttagagagagatattttttgggttgttaaaaggtgaatttttttttaaaatatttttaaagtgcgttttgtagaatattttggtgatgattttgaggtagattttagtaaatgagtttattttttttttttttttaaggtttaaagatagaggtggtttgtagataggttggggttacgttttttatagttagaaaaatttgtttttagtttagaagtcgttttaagaatcgatatagtagttatttttgttggtgttatggttgttgttgatttttttgtttatttttggtgtatttaagagttttgatattttgtttttttaaggagataattatagaagtagtaattttttaggttatagggagataaga

SEQ ID NO: 129 - DNA, 871 bp, Homo sapiens
ttttttttttggtggtttttttttttttttttttttttttgtttgtttttttttttggggatgggagttttgtttatatttttttttttagttgtttgattttgtttagtaggtttgggttttggaagtttaggtagtgtttgagtttgtagttgttgttggagttgggatgttgttgtttttagttttgggaagtggttggggtttatttggggattatgtgtggaggtattagaaagtatgtattgattagttgttgtattttttaaaaatatttatgggagtttgggtttttttgagtttagtgtaattgttgtttaaattgatgattaaaatattgagtaattattatttattttgagtaattagagataatgaaatatttttaaaattaggttatggagaaaggagttgttggattggtttaaaaggtggttttttataaattgttaaaagatttttaaatgttgagaaataggttgtgtgtagaattgtgtgttagagagagatattttttgggttgttaaaaggtgaatttttttttaaaatatttttaaagtgtgttttgtagaatattttggtgatgattttgaggtagattttagtaaatgagtttattttttttttttttttaaggtttaaagatagaggtggtttgtagataggttggggttatgttttttatagttagaaaaatttgtttttagtttagaagttgttttaagaattgatatagtagttatttttgttggtgttatggttgttgttgatttttttgtttatttttggtgtatttaagagttttgatattttgtttttttaaggagataattatagaagtagtaattttttaggttatagggagataaga

SEQ ID NO: 130 - DNA, 834 bp, Homo sapiens
cggttttttcgtttatatttgttcgagtggagtattttattatggaatttttaatttttttttttttagtggtcgtggagttgtgggattgggtttttatgatgtttttttattattttagtttttttcgattaaaaatgttttaaagaaaataatagagttattaattttttaaaatggtggaaaaaaaaaaaaaatttttaaaagtttattttatttgttatttgagaaaagtttagagttttaggaaatttaaaatgtggatgatatttttttataggttttttggtaaaaaaaaaagttttaaaatttaataaattagtgaaattttatataagtaaaaaagagaatcgagggaaatgtttataatatggtattttttttaaatttttattgagcgtttggtattaaacggtataaaaattttaatttgtaattgtgtttattatgtgaaataagtgttatattattttttaaagttacgtttgtaaatgtttttttaggtggttaattttataggaaggggtatttgaataaattttaaagggagggaaggtttttaattattaattagatgttttaaagagagttcgataatttttaatatcgaaggtttattttaaattttgaattagaggataatttaggttaagtagttagtgatttttgttttttttataaagatatttgaattgtaatatattttttaattttaatttattttggtaagttatattttttaatttttttaaagtatgagaatattttagtttatttaagttatatttttaagataaaggtaatagaataatacgtttttgattttatatggaa

SEQ ID NO: 131 - DNA, 834 bp, Homo sapiens
tggtttttttgtttatatttgtttgagtggagtattttattatggaatttttaatttttttttttttagtggttgtggagttgtgggattgggtttttatgatgtttttttattattttagttttttttgattaaaaatgttttaaagaaaataatagagttattaattttttaaaatggtggaaaaaaaaaaaaaatttttaaaagtttattttatttgttatttgagaaaagtttagagttttaggaaatttaaaatgtggatgatatttttttataggttttttggtaaaaaaaaaagttttaaaatttaataaattagtgaaattttatataagtaaaaaagagaattgagggaaatgtttataatatggtattttttttaaatttttattgagtgtttggtattaaatggtataaaaattttaatttgtaattgtgtttattatgtgaaataagtgttatattattttttaaagttatgtttgtaaatgtttttttaggtggttaattttataggaaggggtatttgaataaattttaaagggagggaaggtttttaattattaattagatgttttaaagagagtttgataatttttaatattgaaggtttattttaaattttgaattagaggataatttaggttaagtagttagtgatttttgttttttttataaagatatttgaattgtaatatattttttaattttaatttattttggtaagttatattttttaatttttttaaagtatgagaatattttagtttatttaagttatatttttaagataaaggtaatagaataatatgtttttgattttatatggaa

SEQ ID NO: 132 - DNA, 660 bp, Homo sapiens
ttggttggaatgttatcgttttttagatggttttttttattggaagtttttgtattttttattagaagagaggcgtaggcggacggagggaagtcgagatgagcgttagggttgtattttgttttagggttagttgggagggggagggtattttaaagaggcgttgaggttttagagggtttatcggaagtcgttttttgtggtttgggattttagtttattagtgttagagtgttagttttttttgtttaattttgttttgagtttattagttattaagttttggataggttgtgaagttaattttttggcgtttgtttgttttttcgttcgcgtttttttttttttattttatttaagttcgatgagttgagatttgtttttgttgaattcgaagtgtttcgaagaggcgagttgtgtgtatgtgcgtttaattattaaagttggtggaaaagagtttatttatatttgtgcgtaaattttttcgagttaatattttgtaagtttagtattttagcgtaacgtagggatttgtaaatatttgtaattgcgatgggtatcgaggattttgggatagagtttttgattggtagaattttttttggtgaatttttgcgtgttttgtgtttaagtcggcgcgttacgatttcgggagtcgtt

SEQ ID NO: 133 - DNA, 660 bp, Homo sapiens
ttggttggaatgttattgttttttagatggttttttttattggaagtttttgtattttttattagaagagaggtgtaggtggatggagggaagttgagatgagtgttagggttgtattttgttttagggttagttgggagggggagggtattttaaagaggtgttgaggttttagagggtttattggaagttgttttttgtggtttgggattttagtttattagtgttagagtgttagttttttttgtttaattttgttttgagtttattagttattaagttttggataggttgtgaagttaattttttggtgtttgtttgtttttttgtttgtgtttttttttttttattttatttaagtttgatgagttgagatttgtttttgttgaatttgaagtgttttgaagaggtgagttgtgtgtatgtgtgtttaattattaaagttggtggaaaagagtttatttatatttgtgtgtaaatttttttgagttaatattttgtaagtttagtattttagtgtaatgtagggatttgtaaatatttgtaattgtgatgggtattgaggattttgggatagagtttttgattggtagaattttttttggtgaatttttgtgtgttttgtgtttaagttggtgtgttatgattttgggagttgtt

SEQ ID NO: 134 - DNA, 765 bp, Homo sapiens
acgttttttgttagaatgtttaaaaggtgtaggaagaaaggtaggttttttttttagagtttgaagttttgtattaggcgtgcggtgttttaggagtaggagttttacggtttttaatagaaattttgatgtttagggagatttttgtgagtgtttttgacgtttagggggtatttttggtttatttttcgaaggaggcgtgtgatgggaaaggtagttggtgtggatgttttgggatatcgtacgtgtttagaaacgcggcgggaaggttaaagttttagagtaagcggttgggttgttgatttaggagtgtgtttttttggtttgaggttgggcgtttttatcggttattttaggggtttgattaggtttgaggaagttttttttagttatttattgaagtagaagtcgcggtttttatagacgaattggagggtgtttattagtttttcgtcgtatagggttttattggggcggtaagtagtaatgtagtacgaggcgaaggttaagaaggtgagaagtattagtatcgatttttttattgggatttttattggtgtttgggggcgggagagaagtggcgtgagcggggtagttaggttaagttttaggttagaggtgttttttttaaattaaatttgttaatttataaatttagttgaaaattgaaagtacggtttttttataaatattatttttattataaaagtaatatataggttataatgtcgaggtgagggcgtagggttatgtgtagaatgaagt

SEQ ID NO: 135 - DNA, 765 bp, Homo sapiens
atgttttttgttagaatgtttaaaaggtgtaggaagaaaggtaggttttttttttagagtttgaagttttgtattaggtgtgtggtgttttaggagtaggagttttatggtttttaatagaaattttgatgtttagggagatttttgtgagtgtttttgatgtttagggggtatttttggtttattttttgaaggaggtgtgtgatgggaaaggtagttggtgtggatgttttgggatattgtatgtgtttagaaatgtggtgggaaggttaaagttttagagtaagtggttgggttgttgatttaggagtgtgtttttttggtttgaggttgggtgtttttattggttattttaggggtttgattaggtttgaggaagttttttttagttatttattgaagtagaagttgtggtttttatagatgaattggagggtgtttattagttttttgttgtatagggttttattggggtggtaagtagtaatgtagtatgaggtgaaggttaagaaggtgagaagtattagtattgatttttttattgggatttttattggtgtttgggggtgggagagaagtggtgtgagtggggtagttaggttaagttttaggttagaggtgttttttttaaattaaatttgttaatttataaatttagttgaaaattgaaagtatggtttttttataaatattatttttattataaaagtaatatataggttataatgttgaggtgagggtgtagggttatgtgtagaatgaagt

SEQ ID NO: 136 - DNA, 715 bp, Homo sapiens
taggatttttgtatttgttatttttgttttttagaaagttttgttttttttttatttttgtagttataggtgttttttgttatttagagttttagtttaaatatgatatttttttattgatggaaattattttattattagacgttatgtggtttattgtttattcgttgtttgttttttggttggagaggcgtagggagttgtttgttttttttgtttagagttatcgtttcgtatttggattatcgtttggtagaggcgggagtggaggttgttattattaggatgaaggataggggtggttcggcgtggagaagttaagaagagatggcgataggttaacgcgattgcgtttttaaggtggaagaaacgaagggcgagggttagtaaagttaaggacgggtttagatttcgttattggtgataagcgggatttataggatcgacgtgatcgcggttaggttttgggtggtttatttggatttttatttggttgttttttttttgtattttttcgtttttatttttttagttatcggtataggttaagttagagtgttgaagaaatatacgagtttggttttggaaaggaaaattagaaaggcggtttaaggggttttatttttaggaacgttaagataggcggttaggggtgagcgggtagggtcggttagtaggttttgaaagtagtcgggttattagcgcgtttcgagtt

SEQ ID NO: 137 - DNA, 715 bp, Homo sapiens
taggatttttgtatttgttatttttgttttttagaaagttttgttttttttttatttttgtagttataggtgttttttgttatttagagttttagtttaaatatgatatttttttattgatggaaattattttattattagatgttatgtggtttattgtttatttgttgtttgttttttggttggagaggtgtagggagttgtttgttttttttgtttagagttattgttttgtatttggattattgtttggtagaggtgggagtggaggttgttattattaggatgaaggataggggtggtttggtgtggagaagttaagaagagatggtgataggttaatgtgattgtgtttttaaggtggaagaaatgaagggtgagggttagtaaagttaaggatgggtttagattttgttattggtgataagtgggatttataggattgatgtgattgtggttaggttttgggtggtttatttggatttttatttggttgttttttttttgtatttttttgtttttatttttttagttattggtataggttaagttagagtgttgaagaaatatatgagtttggttttggaaaggaaaattagaaaggtggtttaaggggttttatttttaggaatgttaagataggtggttaggggtgagtgggtagggttggttagtaggttttgaaagtagttgggttattagtgtgttttgagtt

SEQ ID NO: 138 - DNA, 759 bp, Homo sapiens
tttttttttttttttaaaagagtatttttgattattttagtttgtaattaatgatagagatattagggttagttaattatagttttataagattttttttttcgcgtgtgggttattgttatgttggtgggcgtttcgtttatttgaaaggttttttcgtttcgattggggtttgttgttgaagaaggagaattttcggaaaggttgagtttttagtttaaggttaaaacgtttaaggttgaaagttttttagttttttttggacgttttgtttttgtttttgttacgattttttggggaaaacgaattttttattttttttttaaattgttattttcgttttaggagatgaatgtttttttttggttgttttggtaatgattttgaattaaagcgatgttaacgttttttttttttttaattgttaaaagttatggattgtaggaagatggttcgttttttttataggtatgagttaattttgaatgtgaattttttttgattgttagagattgttagtttaggaagtaatgttttatatttgttatttgattttttttttgtttaagttttaaaagagttgttaatcgtattgttgttttttttgaaagatttggaattttatatggttatttttaattttgttattggtttttaatattttcgtgttaatgttaatttttattttatgttaatgattttgtttatgaaatagtgtttttttatttttgtataaataaaggttagtattataattaa

SEQ ID NO: 139 - DNA, 759 bp, Homo sapiens
tttttttttttttttaaaagagtatttttgattattttagtttgtaattaatgatagagatattagggttagttaattatagttttataagatttttttttttgtgtgtgggttattgttatgttggtgggtgttttgtttatttgaaaggtttttttgttttgattggggtttgttgttgaagaaggagaatttttggaaaggttgagtttttagtttaaggttaaaatgtttaaggttgaaagttttttagttttttttggatgttttgtttttgtttttgttatgattttttggggaaaatgaattttttattttttttttaaattgttatttttgttttaggagatgaatgtttttttttggttgttttggtaatgattttgaattaaagtgatgttaatgttttttttttttttaattgttaaaagttatggattgtaggaagatggtttgttttttttataggtatgagttaattttgaatgtgaattttttttgattgttagagattgttagtttaggaagtaatgttttatatttgttatttgattttttttttgtttaagttttaaaagagttgttaattgtattgttgttttttttgaaagatttggaattttatatggttatttttaattttgttattggtttttaatatttttgtgttaatgttaatttttattttatgttaatgattttgtttatgaaatagtgtttttttatttttgtataaataaaggttagtattataattaa

SEQ ID NO: 140 - DNA, 654 bp, Homo sapiens
gataagggggtttagtaggttttggttgatcgtaattgcggtgatgttttttatgtcgttggttttattatagtcgtcgtttaggttatcgcgaaagttgttgttgtttattcgggagaagttcgaggagttgatgcgggaatcgggtttattcgtgtaggagcggttgttgaaggttcgggggttagaggtggatattttgtaggatttttgggttattttgatggatatggtagaggtaggagtggaggtaggcgggtcgaattaggcggagattttagaaggagcggagaagttgttttttggtgaggagagtttttaggaatggttttttataaaagagattttagtttcgggggatgggggggaaaggtttcgtatttgagtggttaggtttagagggggttgggtttaattcgttatttgttattttcgggtaggatttaggtgggggtagtagagagttgtcgttatttaagggttcgttttaattttggagtttattttagtattatttttagaaatttaggaaaaggtagtttagtgaatatgaaattggaagaaattttgttttggtataagtgtttgtaataagtagatttgtttgggtcgtttagttattataattttgatttttgggttttgttttttttt

SEQ ID NO: 141 - DNA, 654 bp, Homo sapiens
gataagggggtttagtaggttttggttgattgtaattgtggtgatgttttttatgttgttggttttattatagttgttgtttaggttattgtgaaagttgttgttgtttatttgggagaagtttgaggagttgatgtgggaattgggtttatttgtgtaggagtggttgttgaaggtttgggggttagaggtggatattttgtaggatttttgggttattttgatggatatggtagaggtaggagtggaggtaggtgggttgaattaggtggagattttagaaggagtggagaagttgttttttggtgaggagagtttttaggaatggttttttataaaagagattttagttttgggggatgggggggaaaggttttgtatttgagtggttaggtttagagggggttgggtttaatttgttatttgttatttttgggtaggatttaggtgggggtagtagagagttgttgttatttaagggtttgttttaattttggagtttattttagtattatttttagaaatttaggaaaaggtagtttagtgaatatgaaattggaagaaattttgttttggtataagtgtttgtaataagtagatttgtttgggttgtttagttattataattttgatttttgggttttgttttttttt

SEQ ID NO: 142 - DNA, 817 bp, Homo sapiens
tttttttattttatatttatttattttttttaattttttttttttttttttttattttttttttttttttttttttttttttagttttttttttttaattgtttacgattagttgttttttacgttttttttagtttgggatagtttttagtttttattttttttttgattttgttatttaggttattatttttttaaggagtatttattgttttggatattgagttgtgtacgttggggttgtagagaggagtttagtatagtttttgatttttggaagtttatagttttagtgggaaatcgttgtttatgattagttttaagagaaatgtaagagaaggtggttagagttgtgggtagataattgggtagagtatatttttgtgtatttgttttacgttttttttttttttagtttcggggaaggaagtcgagtttgattattttatttttgggtttgcgttttttttgttcgttgttttttaaataggcgtatttgtgtgaggatttggagttttgtaattaggagtttagtggggagggtgttttgttttttttgtagagtcgtgtttaaatgaagagagataggaagttcgatggtaaggtttttttatattttaggtttgggtcggttttaaacgttattagttggagttgggttttttattttttaggtttttagggaatatgttaaagtgaaaatgttaaagttaagggaaaaagttaagtagaattaggtttaaattaggagttaaattgttattgttattgttaagcggtaagaaaaagatggtaagaaagattttattagtggtag

SEQ ID NO: 143 - DNA, 817 bp, Homo sapiens
tttttttattttatatttatttattttttttaattttttttttttttttttttattttttttttttttttttttttttttttagttttttttttttaattgtttatgattagttgttttttatgttttttttagtttgggatagtttttagtttttattttttttttgattttgttatttaggttattatttttttaaggagtatttattgttttggatattgagttgtgtatgttggggttgtagagaggagtttagtatagtttttgatttttggaagtttatagttttagtgggaaattgttgtttatgattagttttaagagaaatgtaagagaaggtggttagagttgtgggtagataattgggtagagtatatttttgtgtatttgttttatgttttttttttttttagttttggggaaggaagttgagtttgattattttatttttgggtttgtgttttttttgtttgttgttttttaaataggtgtatttgtgtgaggatttggagttttgtaattaggagtttagtggggagggtgttttgttttttttgtagagttgtgtttaaatgaagagagataggaagtttgatggtaaggtttttttatattttaggtttgggttggttttaaatgttattagttggagttgggttttttattttttaggtttttagggaatatgttaaagtgaaaatgttaaagttaagggaaaaagttaagtagaattaggtttaaattaggagttaaattgttattgttattgttaagtggtaagaaaaagatggtaagaaagattttattagtggtag

SEQ ID NO: 144 - DNA, 1155 bp, Homo sapiens
atagtagatgttgtagtatttttgttaaagaaagagtttagtataaatattttgtagtatgtaaatgttattttttttatgtgaatatttttttcgagtggatgttgtagggttggaggtttttgtttatgatttaggttgtaattttatttgtggaaataaattaatcgtggagttttaattgttttggtggtgaggtgattaatagtttattattggatagaatagcgattataggaagagtattgaagattttaatgtatgaattatgtatgtagcgtttattttttagttttcgaatagaatgatagggtttgtgaagtcgttttagatagttttttgtattaagtgattgtagtgaaatgtttaatatttttaggtatagaagtagtattgattcgggttagtcgaatttggaagatgtaaattttttagtttatagtacggaatgttttatttgaaagtattgttatgtagatagtcggtttttttgttatttaatttgttttttttaggttggttgaaggatgggagcggttgtgtttgtttgtgaggttatagtatgaagtttttttaatttgttttttgttgtaggagagaggcgtattgtggtataattgttgttgtatttatttaaatggataatttgtaatagatattatatttaggacgatagataagttaatatataaggtaagtttaaggttttttttataggttaggtaattgtaaattagaatatgttgagttaggataatggtgatgcgatattaataaggttgatttagattttagtattgtaatgttagtattaggatttttaattgttacgttaaacgagaggtgattttttatatttgatagtattggattatagggtattttattttgtatgtaaaagttttttaagaatgtattagagttcgaatgtgtagaagattgtaaattggggaggggtagtagtagaatgagttgaattaataagtggaaattatttttttgtggggaagttttagtacggttgtggtatcgcgttggtttagattatttttttaatgttaatatttttaaattttagtaaaagatgtgggtagatattagaaatgtttaattttttttttagaagtagaggaaagtattgaggtatttaaattt

SEQ ID NO: 145 - DNA, 1155 bp, Homo sapiens
atagtagatgttgtagtatttttgttaaagaaagagtttagtataaatattttgtagtatgtaaatgttattttttttatgtgaatattttttttgagtggatgttgtagggttggaggtttttgtttatgatttaggttgtaattttatttgtggaaataaattaattgtggagttttaattgttttggtggtgaggtgattaatagtttattattggatagaatagtgattataggaagagtattgaagattttaatgtatgaattatgtatgtagtgtttattttttagtttttgaatagaatgatagggtttgtgaagttgttttagatagttttttgtattaagtgattgtagtgaaatgtttaatatttttaggtatagaagtagtattgatttgggttagttgaatttggaagatgtaaattttttagtttatagtatggaatgttttatttgaaagtattgttatgtagatagttggtttttttgttatttaatttgttttttttaggttggttgaaggatgggagtggttgtgtttgtttgtgaggttatagtatgaagtttttttaatttgttttttgttgtaggagagaggtgtattgtggtataattgttgttgtatttatttaaatggataatttgtaatagatattatatttaggatgatagataagttaatatataaggtaagtttaaggttttttttataggttaggtaattgtaaattagaatatgttgagttaggataatggtgatgtgatattaataaggttgatttagattttagtattgtaatgttagtattaggatttttaattgttatgttaaatgagaggtgattttttatatttgatagtattggattatagggtattttattttgtatgtaaaagttttttaagaatgtattagagtttgaatgtgtagaagattgtaaattggggaggggtagtagtagaatgagttgaattaataagtggaaattatttttttgtggggaagttttagtatggttgtggtattgtgttggtttagattatttttttaatgttaatatttttaaattttagtaaaagatgtgggtagatattagaaatgtttaattttttttttagaagtagaggaaagtattgaggtatttaaattt

SEQ ID NO: 146 - DNA, 1093 bp, Homo sapiens
gttattgttagcgaacgtgtttatttttagtaagagagggttcgagttttattttgtatttttcgggttagagaatagttttcggggttttttagttcggtattggttttatttttgtgtagtatgggttggttttgtagttttaggggttttgttttagatatttagtatgttgtttaaatgtttaattttttttttttttttgatttttgtaatttttttaagtaattttaagggataaagtttttaatagagattttaggtttttggaaagacgaaagtttgacggtaatgattgagcgattttttatttggttttgattttgagtattagagttattttaattttgtgaaagtagtaaatgtgttttattaggatttttttatgggcggttttgggtagaaaatttatgtaggttgttgtattttgatttagtgttattatttagagagtttagagaatattttttagcggagtcgttcggtagggagttatgttagtttttagtaaagacgtttttgtaaataaagcggatttcgaatgggttttagaaggcggtagtaatttaaataaattatgggtcgaaatatattgtcgttcggaatgtatagggcgcgtgtagtagttatagatacgcggtggaaaagtgtttatatttttaggtaattatgattttaattaatttaaggaaattttattgttataaagtgagaaagaaaaattagcggaattttttagagatttaaaatatgtatagaaaattggcgattagtatgaatgtaagagttattaacgttatttagaaaggattattttaggttaagagtatttttttttagttttaaatttggaaaaatagaagagaaattatatttatttttgagtaaatttgaaggcgtgtgtttttgggtttttcgatttaattaggtttgaataggatgtatattttttttatttattgcgtttttttttttttttgtagtttttttttattaaaaaagtggagatttagagttgcggaggaaaatttttgtagtttttgtaggaggttggagtttaggagaattgaacggtttttggtggaagattgag

SEQ ID NO: 147 - DNA, 1093 bp, Homo sapiens
gttattgttagtgaatgtgtttatttttagtaagagagggtttgagttttattttgtattttttgggttagagaatagtttttggggttttttagtttggtattggttttatttttgtgtagtatgggttggttttgtagttttaggggttttgttttagatatttagtatgttgtttaaatgtttaattttttttttttttttgatttttgtaatttttttaagtaattttaagggataaagtttttaatagagattttaggtttttggaaagatgaaagtttgatggtaatgattgagtgattttttatttggttttgattttgagtattagagttattttaattttgtgaaagtagtaaatgtgttttattaggatttttttatgggtggttttgggtagaaaatttatgtaggttgttgtattttgatttagtgttattatttagagagtttagagaatattttttagtggagttgtttggtagggagttatgttagtttttagtaaagatgtttttgtaaataaagtggattttgaatgggttttagaaggtggtagtaatttaaataaattatgggttgaaatatattgttgtttggaatgtatagggtgtgtgtagtagttatagatatgtggtggaaaagtgtttatatttttaggtaattatgattttaattaatttaaggaaattttattgttataaagtgagaaagaaaaattagtggaattttttagagatttaaaatatgtatagaaaattggtgattagtatgaatgtaagagttattaatgttatttagaaaggattattttaggttaagagtatttttttttagttttaaatttggaaaaatagaagagaaattatatttatttttgagtaaatttgaaggtgtgtgtttttgggttttttgatttaattaggtttgaataggatgtatattttttttatttattgtgtttttttttttttttgtagtttttttttattaaaaaagtggagatttagagttgtggaggaaaatttttgtagtttttgtaggaggttggagtttaggagaattgaatggtttttggtggaagattgag

SEQ ID NO: 148 - DNA, 960 bp, Homo sapiens
gtttattttttggattttattgtgttggaggtataaggtcgtgaggttttttagtttttttagagtattgttggggattcgtgagatttggttgtggtcgagatggagtttttttagggatcgaggtaggggatcgggtattcgggttaggttgttgtggtttaggtatagtttttttaggtgttttagtttggagaagatttttttgtttattttattattggtgatttggttgtcgtggagagtaatttagagtagttttgtggtattgttaaagacgtttttttggatggaggtgatttggttgttttggaagtatatatattttatgcgggagggaacgaagggtaggtatttgaggttgcgattgttatagtatatggtcgtggggaagttgggtgggtagtcgtatttttgggggtagtcgcggggatttggaggggatggagagtcgtaggtgtaggttggttttttatttattttataggggtaaggttcgtaggttttatacgggtaagggttatagggatcgtagtaggtggattgttggttgcggaggtagtggaattattaatgagggttatttttatattgggtttgggagagggagaagagttttgttagtagtaggagggaggtttattgtattttgtttttgtaagaagcgggagagaatagagtaagttagtatgagtgagattttatagaggtagtgaggtagagtaggtaagttttaggttttgagttatgtagagttgatttttatgttaaatatttgagagtaggagttttgtttttattttttcggtgtttttttttagtttggttttgtatttggtttagtcggattatggttatttggggtgagttaagtgtatttttttttggttatagagttatagatagaatgtttttgaatgggaatagttgtattttttttttggaggggtagatttttag

SEQ ID NO: 149 - DNA, 960 bp, Homo sapiens
gtttattttttggattttattgtgttggaggtataaggttgtgaggttttttagtttttttagagtattgttggggatttgtgagatttggttgtggttgagatggagtttttttagggattgaggtaggggattgggtatttgggttaggttgttgtggtttaggtatagtttttttaggtgttttagtttggagaagatttttttgtttattttattattggtgatttggttgttgtggagagtaatttagagtagttttgtggtattgttaaagatgtttttttggatggaggtgatttggttgttttggaagtatatatattttatgtgggagggaatgaagggtaggtatttgaggttgtgattgttatagtatatggttgtggggaagttgggtgggtagttgtatttttgggggtagttgtggggatttggaggggatggagagttgtaggtgtaggttggttttttatttattttataggggtaaggtttgtaggttttatatgggtaagggttatagggattgtagtaggtggattgttggttgtggaggtagtggaattattaatgagggttatttttatattgggtttgggagagggagaagagttttgttagtagtaggagggaggtttattgtattttgtttttgtaagaagtgggagagaatagagtaagttagtatgagtgagattttatagaggtagtgaggtagagtaggtaagttttaggttttgagttatgtagagttgatttttatgttaaatatttgagagtaggagttttgtttttatttttttggtgtttttttttagtttggttttgtatttggtttagttggattatggttatttggggtgagttaagtgtatttttttttggttatagagttatagatagaatgtttttgaatgggaatagttgtattttttttttggaggggtagatttttag

SEQ ID NO: 150 - DNA, 1100 bp, Homo sapiens
tttggttttttaaagtgttgggattataggtgtaagttattaagttaggtttagatttaatttttgattttagttttgtttttgatttaagttatattaatttttatttttagatttagtttagtagtgatttagtttatttttttttttttaattttattttgattttgacgattttagttttttttagttttagttttttggttgagttatttaatttttttgtatataggttttattgttttagatatgatttttcgtaattcgagtacgtagttgtggtttattacgtattattatgagtacggttttttttacgattttttgtagagatagacgttggagttttatttggttttgaggttagttgtgttcgcggtatgcggtttggcgtatttgtacgtggagattttcggtatatagggtaaattagttattgtttatcgcgattttaagagtcgtaatgtgttggttaagagtaatttgtagtgttgtatcgtcgatttgggtgagtcgggcggggtaggggcgcgttttttataggtgggcggagtttgtgcgttttttttttttttgtttgtgggcggtgattatgattagtatttgaaaatttagaggtgtatgttgttttagttttttttcgtaagattttacgagttgtttgaatattttttttaaatttagattttttttattatattattttggttttaggagttgggagaaaggaggtaggagttaggaatttgggtttttattttggtttcgttagtttttaggtttgttttgtgaagtgggtttataatgtttgttttgtttatttatatttcgttgggtttttgggaatttagagagtattatataagtaaagagtatttggggttatggttttttttgtggttattgttttttagtttattttcgtgtacgtttttatttgtttttttttttttgttttattgttttttttagtttttattttgtttgttttttggattttaggtttgggagaggggtaggagtgataggttttatttttataggtttggttgtgatgtatttatagggtagcgattatttggatatcggtaataattcga

SEQ ID NO: 151 - DNA, 1100 bp, Homo sapiens
tttggttttttaaagtgttgggattataggtgtaagttattaagttaggtttagatttaatttttgattttagttttgtttttgatttaagttatattaatttttatttttagatttagtttagtagtgatttagtttatttttttttttttaattttattttgattttgatgattttagttttttttagttttagttttttggttgagttatttaatttttttgtatataggttttattgttttagatatgattttttgtaatttgagtatgtagttgtggtttattatgtattattatgagtatggttttttttatgattttttgtagagatagatgttggagttttatttggttttgaggttagttgtgtttgtggtatgtggtttggtgtatttgtatgtggagatttttggtatatagggtaaattagttattgtttattgtgattttaagagttgtaatgtgttggttaagagtaatttgtagtgttgtattgttgatttgggtgagttgggtggggtaggggtgtgttttttataggtgggtggagtttgtgtgttttttttttttttgtttgtgggtggtgattatgattagtatttgaaaatttagaggtgtatgttgttttagtttttttttgtaagattttatgagttgtttgaatattttttttaaatttagattttttttattatattattttggttttaggagttgggagaaaggaggtaggagttaggaatttgggtttttattttggttttgttagtttttaggtttgttttgtgaagtgggtttataatgtttgttttgtttatttatattttgttgggtttttgggaatttagagagtattatataagtaaagagtatttggggttatggttttttttgtggttattgttttttagtttatttttgtgtatgtttttatttgtttttttttttttgttttattgttttttttagtttttattttgtttgttttttggattttaggtttgggagaggggtaggagtgataggttttatttttataggtttggttgtgatgtatttatagggtagtgattatttggatattggtaataatttga

SEQ ID NO: 152 - DNA, 735 bp, Homo sapiens
ttagattttaatttaaataattttgatttttgtttttggtttggtaggattttgaatggtaggaagcgaagataggagtttgtttatgtttgaggtagttagggttgggggggtattgagaaagggtaggtaggggtggaagttgtgagggagtgggaaagagatatagaatagaaggggagttgttggagagatgttttttttattttaattgggtgttttttgcggtttttttaatttgtttgtagtttgagtttagtagtaggagtgtagagttagggtttttttaagtttttagttatttaaatattgttttttattttttatttttaataggatggtttttatggggaagtgaattaggattttttttgtaggtttcgttttaaagttaggcggtagggagtagggaggcggtttttttgttttttttttaaaaaaaattttgtgattttttttgggtaggagggagttacggttagcggttgttatattttatggtttttattttattttttttgtttttttttgtagggattatgattttgggtttttttaggaaaggttttttgatgttgttgatggttttggtgatttagggtgagtattgggggagtagttaggaaataggaatttggatatagaaagggttatttgggtttagattagttttgtttggggttgaatttgagaagttggggagaatgtaggagtttgattggagagtggaggata

SEQ ID NO: 153 - DNA, 735 bp, Homo sapiens
ttagattttaatttaaataattttgatttttgtttttggtttggtaggattttgaatggtaggaagtgaagataggagtttgtttatgtttgaggtagttagggttgggggggtattgagaaagggtaggtaggggtggaagttgtgagggagtgggaaagagatatagaatagaaggggagttgttggagagatgttttttttattttaattgggtgttttttgtggtttttttaatttgtttgtagtttgagtttagtagtaggagtgtagagttagggtttttttaagtttttagttatttaaatattgttttttattttttatttttaataggatggtttttatggggaagtgaattaggattttttttgtaggttttgttttaaagttaggtggtagggagtagggaggtggtttttttgttttttttttaaaaaaaattttgtgattttttttgggtaggagggagttatggttagtggttgttatattttatggtttttattttattttttttgtttttttttgtagggattatgattttgggtttttttaggaaaggttttttgatgttgttgatggttttggtgatttagggtgagtattgggggagtagttaggaaataggaatttggatatagaaagggttatttgggtttagattagttttgtttggggttgaatttgagaagttggggagaatgtaggagtttgattggagagtggaggata

SEQ ID NO: 154 - DNA, 384 bp, Homo sapiens
cttcctgcccaccttatcactggtgatctggttgccgtggagagcaatccagagcagccctgtggcattgtcaaagacgccttcctggatggaggtgatctggttgttctggaagtacacatacttcatgcgggagggaacgaagggcaggtacttgaggttgcgattgtcacagtacatggccgtggggaagttgggtgggcagtcgcactcctgggggcagtcgcggggatctggaggggatggagagccgtaggtgtaggctggcccttcatccaccccataggggtaaggctcgtaggtctcatacgggtaagggtcatagggatcgtagtaggtggactgctggctgcggaggtagtggaaccaccaatgagggtcatc

SEQ ID NO: 155 - DNA, 334 bp, Homo sapiens
ttcctacagcctggtctcctttggcgtttgcgcccctgcatctgagcacgtcccagagggcgccggaatgtcaggccctagacatagcagcggtttgggggctagggggcaggtgaagagacgccgcagccttgaggttgtacctggtagcgtgggctttggagtctgtgcgccttggggaaatgattttcgcgctctaaatctctgttttcccatctgtaaatgggggataatagtgcttttcacatagagttgaggcgtcaacgagggcctagcgcatagttaacacttagtaaatacaagccggttttattataaggtcagcccctcctca

SEQ ID NO: 156 - DNA, 408 bp, Homo sapiens
gcctaaaataaaaacattctctccaattacatatgctggggaggaaacacctgcttccgacaggtttaaagcttggttttggactttttgtgagagttccttatgtgtgcagtaatccaaaatttgtatagttgccctttataaaagtacattaatctagtagacaaatctccatgtaacttaattacatggcatcttctaatccttctgtgataagcagaaatgtaaagttttattcaagttaaggcaaactaacttgtatacactttccatctcgtgtttttcttgttgttgttaagtaggataagttctgaacgtcgaaaagaaaagtctcgagatgcagccagatctcggcgaagtaaagaatctgaagttttttatgagcttgctcatcagttgccacttcca

SEQ ID NO: 157 - DNA, 262 bp, Homo sapiens
tgtaggacttctgggtcaccctgatggacatggtagaggcaggagtggaggcaggcgggccgaaccaggcggagatcctagaaggagcggagaagctgcttcttggtgaggagagctctcaggaatggccttttataaaagagatcccagccccgggggatgggggggaaaggcctcgtacctgagtggctaggcccagagggggctgggcctaacccgtcacctgccacctccgggcaggactcaggtgggggcagcagag

SEQ ID NO: 158 - DNA, 384 bp, Homo sapiens
tgcacccctggcagggagagccagacagcccttacaggacacggaagacgcacgacccacgacccacgagtggcctcggcggcccggggcgcggcgactgccgccgcggagctccaaggctgttgttttgtaggcttggaattcgtgagagctctctcccgctgagagcccgaggggggagggagccgtgaccccacggagactccctggtcaccgcctcccctttgtgagcgggaaaggcttgaaagccaagagaaagagaggctgctcagaataaggggcagggggttaccggagggagatgggcccgaccaccgctcacagtaaaatgcctcgtgcgaattgcactgaagtatacccaacttgagactggctgttttatga

SEQ ID NO: 159 - DNA, 280 bp, Homo sapiens
caggagactggggaggaagggctggctccgttaccttgaccttgtcaaagatggtgagggggtggagccaggccgccggtagcaggggccacccctgccagtgtccagcgtgaatggagggccggtgcatggagatcgagtgacgaatgaatgaggcacagaacctgcgggaatacacacacagctcacaccacactagcaagcacagatttccatggtcttgctgcgtgcccgtaagaaccatgtcagaaccttgttactagaagggtctcatggaggt

SEQ ID NO: 160 - DNA, 493 bp, Homo sapiens
caggattgcaggctggtgccccaaggcagagagaagctgagtcacaacaggtgacttggaagtggggagaggggaggattcctcctagtggctccatagcccaaggaatgtgcagcccacaggttaggaccaccttattcaagtttacgcctgagatttcctgtctcggagaagaacaactcctcgggacgatcatcaaaatcattttgtgtcctgaagtgattcatcccctggaaggcattcaacctcggcctcctcctgacaacacacactttggagctctcagaacatcgccccatccagctgtgctacagcatgtcagattcagtgactgacctatggtggttccctgttggtccgatgtgacagccacctgcgctgcggcagtgacagaggctgcatcctggcttactcctcgctgctgtttccttccaggtttccgcagctagggctcgaaagcccattcggaagtgaccaagaaaggccaacagaa
